United States Patent 10,233,495 (METHODS AND COMPOSITIONS FOR SCREENING AND TREATING DEVELOPMENTAL DISORDERS) - sequence listing, part 28

SEQ ID NO: 261 - DNA, 1662500 bp, Homo sapiens
  misc_feature (757872)..(807871): n is a, c, g, or t
gttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaatacttctccatagagtcacactcccagttgataaatcaaaacttgttggataaaacaaagtaaatttctcctgacatttaaacattgactgtaaactcattataaacacttctaaatatttaatggaaactacaagcttaacatatctgatccaaaaatgccttaaacacctcagtacagacacccacacactatgaggatgattccctcaaactggttctgaaagcagtagctgtgcttttctctatcgcgttcttattctttctccgacgtgctcttagcaccctcctggggattagcatccgacccacatcactcgggaaaagccctggctggcggctcccaggcggaggcaccacggtgaggccaagtgctgctgtccagtaagcctgactgccccctcaggctctttcccttcacatttacttatttattttttaaatcgacatataaaattgacgtatttattgtgtaaacttcttaccacaaaaatgagaactatgtcaggtgatgtatttgctagttagctagacttaagcaggcctttagttttcagtttttaacattgagggaaaatacacgtaaatcaaatttaccatcgtagccctttgtaagtgtacatttcagtggcatgaagtccatccacatgactgtgcagccatcaccaccagccatctcagaactcttcatctcagaaaactgaaactctgtccccattaaacaagaactcctcattcccctcccctggcagccagcattctactctctgtctctgtgaatctgactactctaggcgcctcatgtaagtggaatcacacagcatttgtctttttgtggctggcttagttcactgagtgtaaggacctcaaggttcatccgtgttctagcctgtgtcggaactccctgcctttataaggctgaacactattctgttgtatgtctgtaccacgttttgttgattcattcttctgtcaatggacacttgggttgctcccacctgttggctgctgtgagtaatgccgctatgaacgtgggtatagaaatatctttgcagccctgctttcagttctcttgggtattctgccacaagaggaactgctggctcatatggtaattctatgtccaggattttgagaaatgaccacactgttttccatagctgctactccatttttacattcccaccaatagcgcacaagggttcagatttctccacacacttgttttctgtttttttttttgttttttttttttgagatggagtctcgctccgtcgcccaggctggagtgcagtggcgcgatctcggctcactgcaagctctgcctcctgggttcatgccattctcctgcctcagcctcccgagtagctaggactacaggtgcccgccaccacgcccagctaattttttgtagttttagtagagacggggttttaccatgttagccaggatggtctcgatctcctgacctcgtgatccacccgcctcagcctcccaaagtgctgggattacaggcgtgagccactgcacccggccctgttttgtttttatttttggtgtacccatcctcatgggtgtaaggcagtatctgtctcattatagttctgacttgcatttccccagaggatagtgatgctgtgcctgctggctactcatacatcttctttggagatatgtctacttaagtcatttgtctatttttttttaatttttaatttttagagacagggtctcactatgttgcccaggctggactccagctcctggattaagtgatcctcttgcctcagcctcttgaataactgggtacataccacggcacccaggatggcccatttttgaatcggcttttttgttgttgttgagttttaggagttctctatatattgtggatattaatcccttatcagatatatggtttgtaaagattttctctcagtctgtgggctgcttttttactctgttgatggtgtcttttgatgcatacaacttttaaattttcatgaagtccagtttgtctatttttttcttttgtgaaatgtgcctttcgtgtcatatccaagaatttattgctaaattcaatgtcatgaagcttttggcctatgttttcttctaagggttttatggttttaggtcttaatttaggtctttgctctattttgagtttatagggtatgaggtgggggatcaaactgcattcttttgcatttgtaaatccagttttcccaacatcatttgttaaaaagacagtcttttcccccattgaatggtcaccacattaaaaatcatttggccagccaggtgcagtggcatgtacctatagtcccagctacttgggaggcagaggtaggagaattgcttgaggccaggagttcaagaccagactgggcaacgcagtgagaccctgtttctaattgagaaaaatatcactggtttatttctaggctgtctattctattacattggtctttacatctgcctttatgccagtaccacactgttttgattactatagctttatagtaaattttgaaaccaggaagtatgaatcctccaagtttattcattttaagattgttttagctattaaggggtccttgagactccatatgaatttcaaaatggctttttctatttctacaaaaaatgtcattgggatttttgaagggaatgcattgaatctgtagactgctttgggtagtatggatatcttaacaatgttaagttttccaatccatgaacatgggatgtatttccatttatttatgttttaatttctttcagcagtgttttatagatttcagtgtacaagtctttcacctccctagttaagctaattcttaagtattttattatttttaatgctgagtctcttttgataacaaaacctcttgttatgttgaggaactctttagcccatcttttgtatttgctttcagtttgtgacactttagcatctcttcctgagatgagcgattctttgggtttcatggatgggagagcccattgcattatcctttcatttggagatattgcctggtgtgttgggacaaggaaggactaaccttccttgtcagtgtcttatcacacccgcagggctgagtgacagggtggtcctgggcaggctgcctgtggctgtgcaagctgagtgggtgcacactggactcttcccacctactgatggtgtgtgaggctgatgtgcatggattctagctccttccctgtttctggggcctcagctgtctgtgttcactctttcttgctacacaaagagaaacaaggacaagccttatttgataaaggccacaaacactttgaccttcctccacccagtgtagggatctgtttcccctctcctggactccagggctggtcacagaaggctctgggctccaacctggcttgctggacgtgctcttgaagcccccaagtaagaagtctgagtccctgagaccaccacactgcaaggacacttgaaggtactcaggttggtggtccccgctgtgcccagcccctgaatgaagccaaggctccaagcacctgagtgaagaggctgtgatggaagcgaatcctccagccctggccatcaccccgtggagtagacaaactgctcagcccagcctctcctaaattcccgacccacggagcccacgtgcccagaatggctgttatgctgctctgtttgaggtggtttattaatgtagcaagagataatggcaccaggatgaggccaaatgactcgatttctctacaccccacattttacaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaacaaaacagcttatgagcacctcctactaatttcctcagcttagcacaccctgtggccgttgtccccatcgtccgtggcttcatccctcaactgatgctttcctatgtggacttcccggccagtgctgtgggacctcccctgtagggctggccagcctcatgggctgggctacccgtcccactcagcagtggctgcctggcctcccctctgtccctcctgcccagctcctaatgggcctcccataaaagctgatgcgtgggagccaagccacagctcgctgacctggggaagctgacagagtgacagagggtctcaaggactctccacccacaaggcgggaatggggatgctggcaaatctggtatgaaggttgagaccccgaggagaggcaggcctgggggaccgtgcagcagctgtgcccacctaggaccacagggctggtggggctggcagcttggtagagggcaggtgcacagcaaagttttcaccggtgccggcttgttgtcttccacgctgggatttcacatgaagttctagctaattgagtataagcatttctaaagaacccccggagggttgtttttctttgtgcaaacactccttttgtgcagagggtgttctgtggcttcttggcagagacacaggtgggaaacacctgattgaacatcattgcctggggagtggagacacgcacagcacgtcaacatggagcgcccagcagcggcggcgggtcctgggctgtgctccggagcccttcccgggatcatctcccggcatcggctgacccctcggtgtctacgtgccaagcccaatctgcctgcagggacacccactgccagaggcggaggcaggttctcctggtcccagacccagggccgtctgttggcctgcaggtaacacgcagggaggaaggaaaaggctctaggcacagctgcttgtctaagagggaccctgttggcggcgcaacgctgggtgagtgctgcccgcccgcggatggggtgctggccgaacctaccttgtaaagtggggctgcacagaggtcagcacatggtggcgcccaccgtcgagaggggaggccccttggcactggaggcagggcctcaccaggcagacgtgccaggacccgcgtccctgcacacagctgcccaccggccagtggagtgggacctgctgcccctctgacagctcctggtaatcagaggggcccactccacctgcaccggaggcagcggctggggatgctggagcatacggctccagccactcaggatcccactctgggccgtgaaagttactccacagaacaccccaaggccacccctgctggctgtgaagacaccaccaggcggacagtgcccagggctggggctcacagccacgagaatctggatttgaacagaaaaagcccccagccgcgctgccaccctgacgcagccttgtggggccctgagcagaggaccagctacgttgtgcccgtgcctcgacacatggaaattcttccaataagaacaggatggtgggccgggcgcagtggctcaggcctataattctagtgctttgggaggctagaggcgggaggatcgatcgcttgagcccaggagttcgaaaccagcctgggcaacatagcgagactccttctctataaaaaaaaataaaaaattagctgggcatgatggcctgcacctatgtgggtggtcctgagcttctcgggaggctgaggcaggagaatcgcttgaacctgggaatcagaggttgcagtgagccgagactgctccattgcactccagcctgggggacagagtgagactctgactcaaaaaaaaaaacaccccaaaaacacaggatggtagaacacacctacctgagttggcactgaaaatggcaagaaatgtccgccgttgtttccaaacaccaagttctctctggcttgagaggcctcactgctacccaagagcattatggaggaagatgtggaagggctgcctctcccagttggtgggttggccaggggcgtgatggcagcgaccagccatgctgccaggagtcgcctctcaggttcatcccaggagctgcatgctgaccttcgcgtgctgcctccgggccacccctcctccccacttaatgccttcactgctggctctgttggcgttcctgccagcctacaggaagtggctgtttgctaggaagagaatgccaatgttcaggtgcatcttttccaagctggatgtctggagctgagaccgtttcttcttctgttgtgggggtttcaaggctggtcagacgcatggtgattcatcacgacccaggttctgttgacacaaaggccgacctgtccagagccacatggctctgctgtggacaccacggagcagctcaagagaggaacaggaccaggagggctgcactgctcttggccggcttggaccccagcaccggttctgctgctctcccaggcagctcagccaggtgaatgaaagtcctgggcctgccctccacaggacgtctataaggcctcagaagctggatctgcctggcaaggggggccctatctgcctagccacccagatgcgggcacgtggccccgttgtgcactggaggggtgagggctgtgttaggcatgcaggactcacgctgtcccgactccatccctgcacactgagattcagaacaagatgtgcctggacactgctcaacgccacatggcctggggcagggagctcaaggccaggctagggggcagccgcctgccatccaccctgcttgtgcctttgactgaaagcacgagggccaggggccaactcagggtctgtacaccctgcccacagctcttcatggcctctatgtaagacatcagcaggcagtgccactcgccaacctcatgctggcatgcacacctgggccctcatgtgggatacccacctcgtggctgtgggacgtagggagttttgtaactacagtgatgatgccaaagatgacagggacataaacaggggaaggggtagaggcccagaaccctcagggtgggagctgaggcggggcagatgtgcctttggcaaggctgtcaagggcatgcagggaaactgcaaagccaattcccactccacctaccctgccgctgtcatggggatgtcagaacctgacaccttccctcactgtgacagcctgtgatgagcacccagggcacagctccctcagcacctgcagtcactgcagcctaaacccaggacccttcccctccctgacacctcagtgatatgaaaatacctcccggagtgccctacgcatcctggcggctataggacactcgaggaaaagcagcagggcccccctctccaaaggtcctgggcacctggtggccacccttgtccaacggagccaggccagtacccgagccaggtggtctccaagcttgggccaggggccgctttcccggccagcactgacattcccgtttgatggaacggtccccatggtacctctgaccaacagagaagtgtggtcacaggactcctcaaggactccgggccccccagcaaccatgttcctcacagtggggttggggaggcacggccttgggaccccctgcagtgggtgcacaggtctcactgacaaatccaacacccccatccccaggccttggaagccctcctcggctgtaccccacggcggctggccatgtccacttcactcagtgcagccaccctcaggctgtaatccagcccccacccccagcccggcactggagccttcctggccccaagctgcagcgcccagtccagccctccgtttggcaggtctgttccgggaactcccctgatccacccctgctccggccacctggatcccacacccttccgatccgtcccacacatgttcagatttctgcctggaaacctggaaatgccatgtggtcctgcaggaggctggtgccactctcagggtcaccctctgtatctcatcctgggggtctgctggactcgagtctagttctaggactagaagcccaggtgggggtcccaaggagcatcggcagggccttgcagggcaactgcctcaagggaggccaccccgggccttcagctagaggggctcttccggcaatccgggcagacacaggcgtgtgtggtcccagcttctctggatctgcccatgggccccactccaatattcagggtcatggttctttcccaatcaacacccgcttttaggaggagacgaccggccaggctgggcccggctgcatgcagtgtgaggctctggctgctaagtcctgctcttgctgtgttgtgccctgggggccaccctgtgtgcagccgcagctgtgactgtggccttggccactgtgaggcggtgcttgtcacactcccttgctgctctcgtgccttctgcccagcactcacctggaggtgcaccctgtgcgccttccccactgcaccctctgcgggcaggcgtgccctcccggatcccacatctggcctggccctgtgcgctgcaagccccccttgccgtccctcacaggcacctttctctgcttcactctttagggagttcagttacttcctgatcctgatcctggcctcaacctgtgtgttgggagctcctggcctcctcggggtgaggggtcatgtggacatcgacgcagctatggttggggcctatcatctcctgaggcctggcccaggaaacccacactcggggtggcccattcaacagcaggtgtgagggtggggctgagcatcctgcctggtgggggtctgagggcactgatgctaagtgggggaccagggcctcctcagggagctcccacctcaagcctgcaacttggcaatggaaatttattataaaataccctcagctggcaacacagcaggcccaagccaacgtctcctgcaggcctcggacggccagggctctggctggcccccagagtcaccgtcctgtgatgaggcactccacaaaaggaaataccaacctcatgaagacagcggggactccatggtccttgggccatgacttgctggtcctcagaggcccttgaggtttcaggccaaggctggggcctgatgcccacctccctgcccgccctcctcgtctcccgggaagggagtgggtgagtcatgcgcgtgggtagagtgaccagaggctgatccgctgatccttggagcccgcggccagcaagccatcggcggtgaaggccacgcactggacagcggcgctgtggaaggccagcacggccagtggctgcatcgtccgccagtggaacacgcggatgcggtggtcccagcctgcggtggccaggatcttgcgatctggccggatcgtgacctcggcgatcccgggattggtgagttcatgagtcccacgcacctgtgagagttgggagaggtgttaggccactccttaagcccacaaggcagtgctgcccctggtgccccacctgcagctggaaccaggagagacgcaggcccacaggcccgggatgtgagggccacacgctcctacccagctgacctcccactcttcctaaggccacgatgggggactccagccctcccctcagagtggtcttcggccctgccctgctgctcctcgcaccagctctgaccgactccttccccagtcagagagcagcagagacagggaggtcccagctgcaggagaggggctgggtcccgggacccctcaccccagggaagccactgcaccctagtgcctagcgagaggccacgtcccgggcttgatggcagcagaatgctggcactcctcccagaagaacctcacaaccaccccaaagctgacgagggtgagaaatacaaactccattttcagcaaaaccatgaggtatgtgaacccccaagctcgacagggctgggagcgctgccaagagcaagacccagtggggggttggcaggatgagggggggacaagggggagacgccctggaggcggcaggagccacacagtgtaccttgcctggtgggggcaacgtccccggctgggttctgagagggggtagggcactgcacgagacccggagccacacagacaggtcctacgtgcacggggccgtcggggtgctggcctcttcctgggccgagcgttggggccagggggtggtggcatgtgcctgtaatcccaactactcgggaggaggatcacctgagcccagtggatggaggctgcagtgagctgagatcactgccaccgcactcctgcctgggcgacagagtgagaccctgtctcaaaaaaaaaaaaaaaaaaagatacgctctaataaaattattagacttcatagctaaaaaacctttggtggccagacaaaaagaccatgttgatgagggtgctgtttaggccgtcctcagaatgctccacagccacagggtgccaagggatgacggggtgatgcctgcaaggctgaggaggaaggcgaggtccaagtattttatatccagccaaactgtcgctcaattataaaaacaacagaccaacatttctgaacatgtaagaactcagagaatcctgcacccataagctgttcttgaaagactagaagattaactccagtctcgtaagagataactggagaactgcagcaaatggtctggcagggagcactggacccacttgcctataggatcagctctaagacaatatggggattacggctatggaaccggttattataactcacagaaatatgggaggcactgagagagatgggatggttgttaagttcactgatttagctcagcttttgtcctttggggccaaagatataatagtcaacctcatccccgagagattatctgagaaccccccaccataagtaatgacaaaaatagcattatttccttctcctctcccacctcactgtaggtgcctatgtttccttgtatagctgcataaagtaaaaaaaagatctaaatatactcaacaggctgagtgtggtggctcatgcttgtaatcccagctgcttgggaggcaaagacaggaggattgcttgaggctgggagtttgaggctgtagtaagctaagatcacaccactgcactccagcctgggcaacagagtgagaccctgtctttaaaaaacattacagattagccaggtgtggtcgtgtagtcccagctacttgggaggttgaggttggaagatcatttgagtctaggtttatgattgaatttcaaagtgaaatctaaatctatgctaggtacaaggaggatgccaaaggaactcttggcaaagatatactgggaaaatgcaaataagaacagggtaatctgaataataggaacatttgaattcagggccaaagcattaggtaagattatataaaagacttaacaatgataaagagtacaattcccaatgaagagccatataatcccagcactttgggaggccaaggcaggaggactgcctgagcccaggagttcaagaccagcctgggcaacatatagagatactgtctttacaaaaaaaattttttaattagccatgcatgctggcatgcacctgtagtcccagcttactgggaggctgaggtggaaggattgcttaagcccaggagtttgaggctgcagtgagctgtgatcacaccattgtactccagcctgggtgacagagcaagaccttgtgctccccaccccccaaaataactgtaaatatctgtttagccagtaaactgacatatcatccataaagcaagaacaataggaaagtgtctataattgagaaactggtaccagactagtcttcttgctgtaaacaaccataaaaagtggacaaaatacacaaggcaactgtttacaggcagggagcactaggcagagaagggcagctgatgaggtgggcctcccaaatgcccccacagctctctgcctggagacaatgccatgagcatgaagtccaggcagaacatagtggtcacattaagctgaggaggcagagatcataatctgcagtagccagagggctgaaatccatggggcaaggcaaaggaacagagggagctgaagattgtctgagggggtccctatgagtcttgtgtgagggctggactgcgcatgctcacggtggactccacagggcttaccagagctgcacagttaaacagaacaagttcaagaggtcaacagtgccgggggtccagtcagcctgaatgtgaagactgtgtgacagcctgagaccagctgagctaccagaacggcttcacttcaggaataggattctatcttagagtatggcctaccctagatctaccagaacaaaactagaaaccaagccctgaaaaggtctgcaggagaggcagagtttggaagttgaggtccaccccactaaacaagcctgggaatgaactttccacagacctgccctaacaaagccaaaagccaagcctgcacaagctcaaggtgaacagtcagtaactgaactccataccagaatgaaagcaaacactcttcagagcaaaataacagaacccagagattcagcatgtatcatttaccatgtctggcacacaaacagcaaattagtagacatgctaagaagcaggaatatatgacccatagtcaaggggaaaaagcagttaatagaaactgaccccaaaatggcagagatgttgaacatatcagataaagactttaaagaaactccttaactatgttcaaaaaatgaaaggagctctctcccaccacccaagatgccaaaaggaaagaaggccaagggaaagaaggtggctctggcccctgctgtcatgaagaagcaggaggctaagaaagtggtgaatcccctgtttgagaaaaggcctaagaattttggcatcggacaggacatccagcccaaaagagacctcacccactttgtgaaatggccccgctatatcaggttgcagcggcagagagccatcctctataagcggctgaaagtgcctcctgcaattaaccagttcacctaggccctggactgccaaacagctactcagctgcttaagctggcccacaagtacagaccagagacaaagcaagagaagaagcagagactgttggcctgggctgagaagaaagctgctggcaaacgggacgtccccaccaagagaccacctgtccttcgagcaggagttaacatcgtcaccaccttggtggagaacaagaaagctcagctggtggtgattgcagacgacgtggatcccatcgagctggttgtcttcttgcctgccttgtgtcgtaaaatgggggtcccttactgcattatcaaggggaaggcaagactgggacgtctagtccacaggaagacctgcaccactgtcaccttcacataggtgaactcggaagacaaaggcactttggctaagctgatggaagctatcaggaccaattacaatgacagatacgatgagatccgccgtcactggggcggcaacatcctgggtcctaagtctgtggctcgtatcgccaagctcgaaaaggcaaaggctaaagaacttgccactaaactgggttaaatgtacactgttgagttttctgtacattaaaataattaaaataatacaaattttccttcaaaaaaaaaatgaaaggaaagtgtattcaaataattacccaaaaaattgtcttgagtgagcaaataggaactcttagcagagaaatggaaattataaaaaagagtcataatagaaaatatagaactggaaagctcaatactgaaatgaaaaatgtattgaataggcttaacagtagattggaaatatatattttttaaagtcagtgaactggaagacagatcaacagacattgcccaatctgaagagagaaaaaacgactgaaccaaaacaaacagagcctcagggggccatgggatgctatcaaactgtgtaactcatagaagccccagaaggaggagaaagtgaaaatggtcaagaagaaacagtggctggatatttcccaattttaatgggaaacacgaatatatagatgaaaagctcagcagaacccaatcaggacaagaagaaaaatctatctaggcacatgatagtcaaactactgaaaaccacagataaaaaaaaatcttgaaagcagccacggagcaagacatattacatgcatgggaatgataggatatcatgagttctcatcagaaacaatgtaacaacatctttacagggcatgaagaaaaataaaactatcattcctaaattccatagccaggattctgtaaaaatgagggtgataaagacattttttagataaacaaaagctagagaattttttgccagcagaattgcactacaaaaaaatgttaagaggatacttgggtctataggatgagcaccagaaatggcaaaggggtgagtaaatgtaacatgttatgttttttatttcttgtaagtttttttttaaactgatgatttaaaggaaaactggccagatgcagtggctcatgcctttaatcccagcatgtgggattgcttgaacctaggagttcaaggccagcctgggcaacatagtgagaccctatctctacaaaaacttatccaggcatggtgataggtgcctgtagtcccaactacttgggaggctgaggcaggggtttgagggtgcagtgagctgtgattgcaccactgcaccccagcctgggtgacagagcaagaccttgcctcaaagaaaagggaaactaatattgtaaggtgcagttttgaatgtgtgtagacgtcaagtagatcacaacagtcacagaaagactaaaaaggtgagtagaagggattgcaccagcacaaggtcatcatgtttgtgaggcgggatgtaaacaacactgattctaaggagactttgagaaggttgcacactcttggagtgcaaccacttaggaacaaaagtggcaagaggtctagctaagaagccaagagaggaaacaaaaccgaatactaaaaaataaatatttgattaccacaaaagaaggtaggaaaggaggaaaagtggtcaaaaatggaagtgacaagtagaaaataagtatagaggtgttagacttaatcccaggcatgtcaataattacagtgaatgcaaacagactaaatgcaccagttaaaaggcagagattgtcagaaagcatcacaaagcaagacacatctgtctgctaaagatgcttttcattgggaggccgaggcagacggatcacgaggtcaagagatcgagaccatcctggacaacatggtgaaaccctgtctctactaaaaatacaaaaattagccgggtgtggtggcgtgtgcctgtaatcccagctactcgagaggctgaggcaggagaatcacttgaacctgggaggcggaggttgcagtgagccgagatcacgccattgcactccagcctggtgacagagtgagactccgtctcaaaacaataaaataaaataataaaataaaataaaataaaagatgctttttaaatatcaagaggtcaggacaggttgaaagtagaagcaaggaggaaaatgcaaagggcaaacctaagaaagtcgatgctactgtttagtatcagacaaagccaacttcaagacaaagagcattaacaagagacaagggacactttgtgctgagaaaaaggctctgcaccaagatgaggtgacatctcagcgcctatacacccacactgagccccagagcttcaaagctcatgaagcaaaactggcagagacaaagaaacaggcacgtttgcaatcacagttaaagattttaagagccttctctgcgtaactggtaaaaaaaaaacaaaactagaccaaaagatcggtaaggatattaaagactggaaccacgtccactgacctgggtcaggctgacggaaggctccaccccacaactgcggaacacacgctcctttcaagtccatgtggtgcactccccgagacacgccatgtgctgggccaaaagcaagcctccataaatttctaaacactgcaattgcactgcgtgcattcactgacaacagaattaagctagattaaagatatagctacaaaatcaacgaatatttggaaattaaataacacacccccaccaaggaacctacagatcaaagagaaaatcacaatattctgaactgaattaaaatgaagacacagtaagtcaaagccaatgagactgagtcacatggaaggtggccaggctgggagctgaattctcagcagcccagggaggtggcaggacctagacccatggcccagcagctgctgctgctcagagaacggcccctcagcatccaggcccgtgcatcagaggccaccagcacagccaccaagaggcccctgcctgaggaatccctaaaggatgcgctttttggcttccagaaggaggtcttgagatgtaagaacacccagggcaacgctcacacacgacatgcaatcatcgatgtgagaactggctccataagagatgtgtctacgcctggagggccaggaaggttggaggtaaaatgattaaaatgtaaaggctataaagggaagtagtgaccaaaagaaacctggactgagccatattaatagttggaaaaataggctttggggcaaatgtcctttctagagatgatgagggggaatgaagaaaagacctcattcaccaggaaatcaccattttaaactggcatgttcccaggccagcttcaaagtgcataaagcaaatacagacaggcccccagcaaaagggaacaggacaggcctctctgcgcctgctggggaccatggtgacctgcaggatgacttaaagggctaagaatcagtggacacacgggcctggcgcccacgtgtgcagcggggcatctgacaaccagcactgcctccctggcacatgtgcaatgcttatgaaaactggacggccccgcatttcaaagaactaatatcattcagaccttgttcccagaccacaatgttaattaagttagaaattgaaaactaaaaaataactggggaaaaaaatcaaacattcagaaccataaaaacattctaattaactcagcagccagagaacaaataaaaatggggtctttgtgtcaaatgaggaatatggggaaaaaataataaaaatggggtctgcctggaagtggggggaggaagacaatgtcttcttgcaccagggagcccagctggacagtcacctctggaaacaggctccatgtggggctggcaagggaaggctgagtgccgatgggctgtgcacctgaccccaggcagggcagcagatgcaacccaggggacatgggatggagggagagcatggcaaggacagaaacaatgaacagaaagatagaaatgctcaaggacaaacgcatacaagactgatcaggaataaagcagggacggagctttgaatgcggcagaaatttaaacaatcatcacaagcagtccaaaaaaggtcactaggaatacaaccttcaggatttgtatgcccacagacaaattcctagaaaaattccccaaatcaggaaacctaaattagtccacaaagaaaacaacctgggcagagaaaataactgcccagtaatggtgcaggcgaagaccaacctacagtcactcacgaccccccacctccaccgcccaaatgtgtccatccatcgggagaagagggaacgctccccaccagctccctgagcctggggctcctgtcactaggcaggtggtgggagagggaggcccaggtccgtctgtggccctgggcagttctggcccagcccagcagagtgggcggagcacatgtcacacacgggagggggggtgggggtgcaggcggtgatttcaagacttttccctgagattcagggacagactgaggattttagttgttttaatgtttaagaaaactccaacaatgcaatgaacagattcaagaagaaaacctgtatgagttggagagatgcagtgagatcatttagtgacatcaggcacccattcaagacccagattctttccccaggaggggtgggaggagcctcgcctggcgaggagatgccaccaaacaacccacagctagcgcagccctcaccctggcctgggataccaccgcctgcgcccccaacactgctctaggctcctggccagtgaggtaggcgccttgccatgccctcagccacctcgccgtcctacctcaacaccagcttgtctctcaaggccaagcccctgcaagcccatcatcctgccctttcaaggcctctccagggcccggggccccctggttcacggacttaccaaggcctgcagccctgacccctctcatggcccctcccctcccaccgcgcactgtaaccagcacagtcccagcacatcccagacgctctgcctgtcctctacctctcttgcctggcagaccttggctctgggggtctcggcggtatcctgcctgtgcacacacaagcagctgaatgtgctgcagcacgacacacagccattggttggcaaccgcaagcccaggctggcctcagtgtccagagcacccggccttggcgctgcctcccctccctccacaccagcccctacctccccacttggctccctgtgacccggctgaggggctgtcaaggccagcacctgctgcgcggggccgtcaagtccagcacctgctgcgcagggccgtgaggggatgctggcatgtacctgtcatgcgtgtggggttcgccgcctgtgcttgcagacccaggagcccctccccagctctcagggaccagaacacagtggcccagggaaggaactggcggctgggaagaacaggaggctgatttgatgccatcgtcacccatttctctcctgtgacctctgccctaagtcagtggtagagagggaacaacaggccacacgccatgggcctcactggaagccactggggcctgctcagggccctcttgacaggaatttgctggcaggtccttcccagggagaaaagagctgccaaatgcctggagccacaggcgtgtggggaggtttccgtagaagtcctgaccagggatcttcacctgtggaggctgagatgcccagttcctcctgcccagctcctgcccagcagcctggctgtgcctacccaccagccaggcggccactgcctgcagggacaggagcgaccccacacccacctcagccattctcagaaagcagtgacagcatcaaggtaaagaaaaccaggttcaaggaccagcttcccgcaggaaatgaggatgatgcgggaagcctggtggggcctcctggagaaagactagggcctgctccagccctgtgttcctgaagaagaggaggactggtcctggccctgcagtgacagcagccagggccctgcactaccgtgctcctgatggcagatggaaacatgtccacgccctgcacaagcctctcctcctgatgcgatgcacggggagctgacccggggccctttggcctccctcctggctgcccagcagctctgctactgccctctaaagggaagcctctggcagacagcgcagcagccaccactgctgtgcagatgggagcgcagctgggacacctggccatgtcttgtgggagagccacggttggtccacttcccagaccagggctgcctggggtgggggagcctcattattacttaaagccctaagaatatggctggctgtaaatcagtccccacttcaaggctgtgggcactaccccaaaatgtgggagggagagggcctgcgtaccacctgtatctgatgacaacacaggctctaactgtgacagctcacgggaaagccgcctcagcaaggcaggctcagggctccagtcaccacttgaccccgaggcaccctcaggtggtatcctgatgtgggcagcctcctcgtcaccaccgcggcccctggccaagccccagcctggacctgggccttccaggaaggatctctggccaccagtggctctcgtagcgcatgacctcaggtgccaggaatgcgtggtgcggcgaagccaccatctggttccgattacccatgctctgctccaggaacctcattcgcgtctctactcccagcacccgccggggggagactgatctgggctcatcagaggcttcggcaggagggtgtgagggggacacagccgtgcccacgtggctctcagccaaggagtcacagtgcaggcggtgggtgaggacacctgtgggtgctgaggaccttcggtcaccttgcttgctcccgggtggcaagaacgctctcaggcagctcacctccgaaagcgcccccacaggctttccctgaggctggggctttacagaacctgcaatctccagggcctctaggatcaacgttaagatgtgacattgggcagagggtggcgcatcagcctctccggctccctgtcccctgttcctggagtcgcctgtcccctcccaggcctcctcctggcccatgcaacacagggctcagcaggggaaacgcctctccttcgatgtgcaccatgggccgatgccctgcccagcacgccacagccacgccaaccactccctgttcctggttctcccttctgctctcactttccaattcattaatacctggtcccccttttgctttaacttttcaattcatcaatccggtcaagttcatctctggactggaacatgccccataaattacagtcctaagttccagcagctgtttcccaaacacaccaggagagacgaggcagatctgggccaggacggcaggagggccccttcctggggtcctgggcacagaggtggaaactgcagagaagagccctccgggggctctcagggaagctgtctgggtcttcagcgctttgctgtcaggctggtgaaggacaagccagtgccaagtgaacactggaccccatgggggcagccctgcaggatccctgccaggcttgaggaggagggagggagtgcaagggagacgccccttccagacatgcagacccagcacccagagtggctctgcctcccagcgcccagagcagctcagcttctagctgctcagaacgggcatcatgatgatgacacatccaccgaccacccaggcctgctaagccttaggagacccttcctcccggggagacatgagaagctctgccgcttacatcagggccttgtgcccccatccccaggacagctgacggatgggtgagggatggacacagctctcctgcaagtctaccatgtgcctgcacaggttggtgatgcccacagggcactggggccgctcacagaaccctgcccctctgtgtatcctagtctcaccagggcatgtccttccgcagctccaccatgtgcttcaaagactctggtggtgcccactcaggggtgggcctgacggacccgaggtgaaccctccccgccccacaggggccagggctgggcaagcgtgaggcgcagcaggcttgctggggctgcgggcaagtctgccctgcctggggggcccgaggaatgccctctctgtggcctcctgtcgtacagacagcctggaccacagccctacagagaagggcagccccgggccctgtccttggtgaggctgggagctgttgctgcttctgccagtagtcacctcacgggacatgcagctccccctggaggcccttcacccactagactgggcaatctgaccactcgctggctatgggtctcaggcttccaagacttctggtgaatgggggctccttgtccaccccccagaagccaggatgtacccaggccacacccagcacctcatctcccatggtctctgcagcccctgagacttgcaccagagtgagacctggacaggagactccccttgcccccaccagcctgacctgatccctcccatcccaaacagggccacgtgtaggccaggccaccctggagccacaggcccagacagggacaccacggtgcccctcgagccatgccagctaggagagcccaggagacaccatgggaagatcttcagcaaccgccaggtggccctgaggcttcccagccttcctgctgggctttcctgctgcccgtgagcaatggcctccctcgggccagctccagaccaccacgggggctgcagctcctcgcagttttccacactggttttttttttttttttttgattaatcagttccttactgaccaaattcctctgagttttcacaaaggggtttgagtattcctggactctgcgtgcctttctctagatggacaagatgtgacggcatgaacccgaggtctgggcgaaacccaaaccatgtgaatggtctgccagcgcccacgcccccttcttcctgcgccagccatggacagcccccctgcacccgcctccaagtgattaattagccagggatctgcaacaactcctcttcatgcctaaatattgtttcagcctatcagactgttagtgcagagcaggataaatgagacccggggcctggcgcactgacctgcagggcctgctgccagtccaggctccagacagccagcgccttccccgcggagcctgagatgcccctggccttctgggagtcaaagtcaaggtccatgacgggctcctcatggcaggcgatgcggctgcacaccttctgctcagagacgtcccacaggaccaccgatccatcctcatagccggccagaaggagtgggcgggagctgcagtcggcctgcggggaacagcagagcagtcagctcctggaaggaccctgactccagtgagtttcgggggagaaggggctctggaaattcctgcccctcctgctggctggggctgtttcccatgtcttccacgtggctgccacagctcagaagctctgcaccgccagtgccctcccacacagcccctggatggctgatgctgtcagcatgggactggcacggctgcccttagggcaccccaaggacataggggtggagggcagagagccaagcccaaggcctcccactgctgtaccacttctcaccagccctgcaacctgcatgtgcccaccctgggttctgcccaaaggggtgatgctgggcacccaccagccactgtgagtgctgccgaccctctccacttctcccatgcacagggacctgtcctcctgcctcctttccccaggcctaagatgtgtggccaccacttactggggctggtcacctgtctagagccgccagccagaagaaaccgtgagctccatctccatgaaaaatgaactctctgtgctttgtcaaagtggctgccgaagcccctgcccctgaagcctggcgtgagccgcccgagctcttgtgatgaatgagggcgcgggtcagagggctccaagccctgggcagacacctcgtttgttaagcctctggaataattgcaggaggagagcactgcaggattccgcatcaccctggggacacagccgtcagtccccggcaccaagaatgacagcccagagaaacctggcatggctgagcaaggagacctgagggagccagaaggcaccagggcgtgtgcctaacaaagggatgctgagtcctcagacaccacaaggaccagggctcgctgcatcagaaggctggtgatgggaaccggggtagccaggcccggagcccgaggccaactgccctgacctggaggggatggccatgccagggacagaaggacactcactgtgccctgcaggatgtgggcatgtgaacccgaggccagagctggtccagtggtcctcatacatgtccctgaaaaagacttgtaaaaccactgggttctaataacagagttcacacagacaaaactgagaagagtgaggctccaggaggaggcgagtggcggtcagtgtgtcttctcccggggcacctcctcccaggcctcatcccaagtcatgccccgctgccagagtccacattgtccctgggaggcagggctgccccagggccccgagtgtactcagccccctgcccctccctgcagaagtcctggccacgctcctgcgtgtgctgttttatccctgggaggagttccatgttggcacctttcagatcacctgctgggaaatgaggcgtgcagggacccacagtactttccttcccaacatgggcaccatgccttctgcacagaagctccttgcaggcagccctggctccctagaagggcctccccctggtaagtggtgcgtctgaactcacagtgggtgagggccaggcgagagcagcggggaacactctgcatcccaaccaggaatgcaggccaaccccagaagctgactccaaagactctcctcattggacccactcccctcaggcagcgctctgtggtggcacctgttcccagcctgtgccaccctcctccccggcactttcctccactgcaggagctgagactgcctggggctgctcccatcaccgatgtccttctggcagtctcagagcctagagcctgtgtgaagccactgcctctgaattcagatgccatggccaacgcagggactgtgtgtgtgactgacccgcctgtcgtggtgccacagggtggctggagcagaagccaacctggcctggaggggcttgccctgtggttgccagcccctgctatgcccctggtccctgcagccccctagtgacagataccacaggccgggcagtcctcttgtggctggagcacttcggtgcccacagccttgatgctgcctgacctctgcaggggagaggatctgaagtctcctggacctgttcttctctgccccctccctgcccgcagatgagacctggaggccaggcctcattctgcacccctcccattgactggcacccccagagggacacagcaggtcaggggctgtgggaagccctccatgcaccataccccaagaagcagggcagggctggctggagtggcccctgccctgagggctatgccagtgactgcctcaggcttgacgtaggtcctgaccttttatatattaatagcaattattcttatgttgcaggtcagctgcttagaggagcaaaataagaatatactaaaaattaaaaattaaaaaattttttaaataaataaaaatgtgattgccccccaaaaaaagaaaaccctcaatgtttcagaaaaaaaaaaagcaagtcaggccactgtgccacaattggattgataaattataacctgaccctcaggcttggggatggaaaagggaacatgtggagttaatgtcggcttttcttagcggaatgcttcacgctggatctccatcaccaacagaaacacgatttgtcctctgtcaactacattaattaccttaacaagtttgtacatccctttctacgcatttttctgttggaattttacatgattgtgcaatgacccacgtttcccaaggggtggaacaggagccgtgcagactcggacacccttccccaggacctggatgccctgcccactgcctgcggggttgcagccttggggggcgtttttcctcccagcggagcccatgtcaagcccttggaggagccttgtgtgggcacatggagcccagtgacccaggctctgctgcagtccctgtggcccggctgtgagcctgctggcaccgagtttcatcatctcaggtgagcctcccggaagccaccctgcctcctgtgagggcttctccccaaatggccacagccacagaagcagcactacaggatcagtccacgggagaccccaaattccaagtgaaccttctcagtcaagaaaccacagggggaagctgactgcagtaaggggcgcccactttctggtcacgtggagagagagaaaagctgggggcagggactctgggggtacccatcccggtgggccttgcagggcatgcagatgcccacaaactgcacaggcccatccggtctcgctctcatgaggaggtcaaagaggcagcgagccagagtcacctcccggtaaaggcccagcccagggcagttctcagagccaaacagaaaaggagggtgcctgggccgggcgcggtggctcacgcctgtaatcccagcactttgggaggccgaagcgggcggatcacgaggtcaggagatggagaccatcctggctgagatggtgaaaccccggctctactaaaaatacaaaaaattagccgggcgtggtggcgggcgcctgtagtcccagctactcaggaggctgaggcaggagaatggcgtgaacccaggaagcggagcttgcagtgagcagagatcgcgccactgcactccagcctgggtgacagagcgagactccatcacaaaaaaaaaataaataaataaaatagaaaaggagggtgcctggcatgacttagggcctgggaagagtgctgctggtgaccccttaccgtgggcttccgaggcagctcagggctgaggggctctttgcaagtgaatgcacgggatcacttgctctgcagccctggacatgagcggccccgaggagggcagctacaccttgagccagtgctggcctgaagggtgatgagggaggagactggcctcgaggaagctgtgctgcatggaggcagctggcccagaagagtccctcccagcaaccccgacctgtgccccggctgatgccttccaaccctgtctaaccacaaagaacagttgagaaggaaggaaatgttcatggatcagaaattccaaatgtggcctcagggaatgtcattgtgttaagtccactcctgcctctaagaggcaaagaagtaataaaaatcaatcctaagcaaagcgggggccgtgcaggcttgctgcagttagtcagcgtggcctgccctgccctaagcacggcccaagtactgaggcgctggcagaccccactgtcccctcctcaccgctcactggagggcaccacgagctgcggggtgagcccaccggagcttgcaaaggacgaggacctgctgccactgctgctggctgaagccaggcctctcctggggcactgacaggaggccccttgcagcagcaggaagcagagggccgtggggacactgaggcagctgcacaggttccctgcggcaggggggtggggtgttgcctgagtggctcgacgataaatcagatcctgaatggagcatgactcatggccgtgggtgtggccggcagggcgtggctggtgcacgcggggccttacctgccacagccgcaggcacatgggcatgcccagcttggcatctgccttcggcttcagggcgcacactgacgtcttggagggcatctccagaatctgaacctgacagtaagaaaacaagttgatttgggccgtcgccaagtcgagtctgcgctatacaaacaagagactcttaaggcgattagcccgggctgctgtgagtttctgtctgctcccctccccgtgggcacctgggagcccaggctcctaattaggctgcatgggcccttgcaaaacgctctcactgttcccaggtcaccgcctggcagctgccccagcctctcccgacgttaccgtgcaggctgagcaggaggctggttcactggcccctgacagagcccaccgattctctctccttcctggtgtaggctttacatacgaaccagtgtgagtgatctcaggcatagccatggttctaagactcgcccaggagcacctagggatttgccacccacttgagaaatgaatgtgatgtgcgtcctctgagggcagctccgggaaacctggctcccccacctggacgccccggtgtcccctgtgcatcgaggctgcattccaggtcccctgaacacaggccagggcccccctacacctgggctgggagatgtgccatgccggcttgtggggtgtaggctcgctggtcacacatctcctgaacagccaggtcaggggatggccgaggccacaagcagcagactgccaggtggttctgctggaatccaggtccgcctgcaccctctgccctcgctctgggaactggggaggctcagccagcactgaacttccccaggtacaagcgagagcagctcactggcccctgacagagcccactgattctatctcctctgtctgcttctccttcctggtgcatgttttacataggaaccacttggaatgagctaccgataacacagcaataatatcaatgcacagccaccttggacagagcctggcatacatggggcatcacccactttacacacaaggagtccaagcccctgaggctgggggctctgagtaggcagaactcataccagttggtccagcggtctctggcccctctattctcctgagccaggcagagggatcgtgtcttaggggcctgtgcctctgtgggtgagaagcttgctgccctcactaacccacacagaataggcccgggaccccaagtctgaatcccagatctgccacaggcatgctatgggtgtgctgaggtcacctccgggcagggcagagagctgggcccacagcccggtccttccagctacagagacctgctgaggcgcccacctccagtacgcggaccagggccacggcgcttcttgtgcaggctgctcttgccaggggcccccacagcagctcagcctctgccagcagggcttctgctccactcagcaccaggagcttagcctctgacagcagggcttctgctccactcagcaccaggagctcagcctccaacacagggcttcagccccactcagccccagggatggctcacagatctaggccccacacaaacgcatgcacacacacatgcatgggtaacatgtacacacctgcacacacaaatagagcctcctgcccatcaagcccagaaaccaggggcctcagggggagccaaccatctgacgaaaggggcccccggggaacaaacagagcaacataatgaagagggcaaaaaagaactcagtaatgggagaggtgattacagtcaggaaccaagaggctcagtgatggtgagaccaggcctgcgagctctggggaaggttgtcaagcctgaactccaaagccggccaaaatggtaagcaggagggtaaaacagaggtctctgtggacaccaaggattccttgcggaaaaaccgctcaaggagaagctctagccacatggaaatataggaacattgatgtccaaaaaccaagacgaggtgccactgagcctggcacagaagaacgtggagaacccaggagaagctggggcgggcttagccgttctttgtcttctgcaagtaacagcaactccgggacagggttcctcctcttaggatcagcatggccactgagtgaagagctagaggcaccagggcggcctgcaaggaccagagttatagcccatgtgccacctctgtgatcccagctaagggagcagtggcaagctgtcattgggtgttgccaccattgtccctttgctgttttcaggaagggtctgtgagagccaccgtcagggctgtggggagggtctgggagggtgtagaccacactgcctggctcactccccacatttccaaatgatacgggagaggggcagggaagtgctaggaagggaagtcacctggcaagggctccacccccgggcctgtccctatagacctaggtgaggacaggcactcctgccttcgcacccaaatgctgcatttcccaagaccaccctggctcaccacacccccattctgtgcctttaaaaacccccaagaccatagcaagcagagacacaagtggctggacgttgagaggacgttgaggggagcacggtggtggaagagcacaccgacagaggctggcatgctggcaggccatcaaccagcgagcggaatgaggtggaatctggccgggcagttggaggagagcccaggccacccagcagcccaactccaggggaaaaccatctcccttctggctccctcatctgctgagagctacttccactcaataaaaccttgcactcattctccaagcccatgtgtgatccaattcttccagtacaccaaggcaagaaccccaggatactgaaagccttctgtccttgcaataaggcaagggtctaattgagctgactaatacaagccacctatggacagctaaactaaaagagcaccctgtaacacacactcactggggcttcagctgtaaacattcacccctagacactgctgtggggtcaaagcctcacagcctgcctgtctgtatgctcccctagaagtttgagcagtgggacaccgaggaagcgaaacacacctccattgcacgccccgggaggggataagggaacttttcccatttcacaacctgttttccccatattaaattgagaagttttgttttgttttaaagtcagagtctcactctgtcacccaggctggtgccatcacagctcactgcagccttgaactcctgagctcaagtaaccctcccacctcagcctccccagtagctgggactacaggtgtgcggccaccaggcccagctaactttttgcagagatggagtctcactgtgttgcccaggctggtctcgaactcctgggttcctcctgctttggcctcctgagtagctgggactatgatttcctactttttgcactcctctgtgccagatttcttaaaataagatctgttcttcttgtcgctatatcaggaagatgggctagttccagcagttaatggggtggggaggtaggggacttaagccaggggcaggaggagccgccctgagcacacctgtgcctctgtggggtggggagggctgcggaggaggcaggcactggctacacagcctacacggccatacacagtccccaaccaaggaaggcctgtctcaatttgggctccaaaagacccctctggggacagtgaggggacatcaagggcaaaggacttgagcaggccagtgagggcaggggcaaaagatggggggaggaggggtgcggtgagggcagaacccagggcagccctgatgccccactctgggcgctgcaggagggagcgggggtggcggcgccttgaaccacatcctgggtgcaggggagtggtgagccctgggcctgagcaccagaggtacacaccacgtctacctgggctgggtcctcagcccggggctgcccctgcctgcgcctgtacttggagcctcctacagacacccatgagctttccgcctggcacctgactgcaacttttgtttccagaaggaaaaatgttaggtttgggcaagtgtggccacccagccggccgagtggggtgggagtgcggctccctgggcgttgtctgggtgcaggccagtgaggctttctcccgcccagtctgacagattccaggtgggaatgtggaaagcaactgttttcccaggatgtgagaggtccccagacaggctgccccgggaaaagacagatgctgccccacagggagagctgaaagctaggaggagggttagacagccttgagcacaggggacgtgtggcagggggcagcgcaggctgaccgagtgctggctggcggcctgggggtggccgagaccagcgcatggagcacagcaggccaagggaagagctgactcaaactcctgcagcattcctgtgggtctgtagaccttgggtcccgggggaggaagcacgcccctctttctcacataaatacaacttgtaacaggtttttggcagattggcaagaaaagtgtatgtagctcctaattggttatttaaatgcaatgaacaaataaatgcctgttcctatctcattatttctgtactggatctgcctgaagacagaacgactctccttgggcaggggccaagcccaactgtgcgtgggggccgtcctgcccagtaccagccccaaagactgcccgggcacagcgaatggggaggactcggcagtgggcatggacagtagcccccacgtgtgcgccccctattccatggtatgtcctccccatgccccgccctcgggccaccatgccccactcaccaggtgggacagtcgccactcaaaggctcttctctgatttcccttcagctcccccaagagctgagcctccagccacaccctcctccactatgacaccctccccgcacatcttgggcacccctcccttggcagaccctgcctcctgtgccactgggggtgtggataccactgtccagctgggccagtcctgtgttaccaacacctctggtcattctggcctaagctccacctaacagtggcctccctgcttggtgatccccccaccccctgggtgttccctagctcacctttcccctgaggactgtgatcaccaccttgtgcctgcacccacccatcccagccctggttgtgtgccctgagataccaccctccctgctgccctgggtcagccctccccaggcctccaacttcaccagggacttggtctctctcccaccgcctcctgccagctgccccggagcgttcctcccacttgggtctaaggtcctcagggcctgagcagtctctcccctgccgttcctgccggcctcgggcctccatgcttggccatcccacgccactgtcctccatgtgcagaactatgctgggtgcccaggcctccaaaacaccggcccctcccccaacgcctcctgattctcccactgccctgggaggatggctcatcagcaaggccaccccaaggggacaggcccaggcctagccggctgtgcatcagccccggctgctgaagctgccggcaggtgggcggctccatggagtcctgtgggtaggcgcaggcgcctcctaatcaaatgcagaggatgagcacaactgtttggagaacatggggcctcaggcaggctggctctcacctcgtcgctgcccctccctggcacggcaagcgtccagcgtggctggcccccggccaggatgctgctccggcagaagcccacactctccaagcacacggagtccacgacagcgctcctgccctccgcgaggtcccacaggcacagcttcaggtcccggccctgactgccagacaaagaggagacaggcctgagactccccttgacaagtgtcagctcccatggcccctgcagcggaaggaaggcaaggccatgtttccagagagtgggtgccgtgagcttggatcatcgcaggtcgggagcctcagctgaggaagggcctcaccgctctggcattgacacttgagccagcaccaaagtgcccgaggccaggacatgcagtggatcaaggctgtggactgatggctgtccagcgtggccccggggtgggggacaccaaccctgcagtgctgcacagcacagagagcaaacttcactgtgtgcaccctaaaaccagcaaactcccagggtgccaggatcccaggaaggactgcagactgtgacaagggggagaacagaggggagccaacctgaggcattttggggtagtgctcatgactagatgcttatgaggttaaagacaaaaataactgtgcagaaactgttccagtgggtgaattagtttctcagaggggtgcaggttacagttctgaatcctctccacgcgtacacctggtagaacagatgaggaaaccagtggtggctcatgggcccggggtctcaccacagggagatgtgacgaagaggcacaggggagacatgggctggcggagtcgaattagaattgtaaagtcaatatgaacaacgagtgtttgggcagatgcacagacagaaatgagtacagacgggtgtgtaagcacaggtcagcgggcacccaggcgtctcccggtgctgtccactgagaacacctagaagcaatgaccacacctaacccaagtcttggtttcttatgctgttctccaaaaacaggaaccagggctctggagaaatggctgagtctagggtggagtggaggaaaaccaagaggagtctcaagcatcctgtagtgccaggcagtgagaaatgcttcaaaaataaaataaggctgggtgcagtggctcaacgcctgtactcagcactgtgggaggccgaggcaggtggataacctgagaggtcaggagttcaagaccagcctggccaacatggtgaaaccccgtctctactaaaaacacaaaaaaatcagctgggtgtggtggcacgtgcctgtaatcccagctacttgggaggctgaggcatgagaattgtttgaacccgggaggcagaggttgtggtgagccaagattgcaccactgcactccagcctgggtgacaaagcaagactctgtctcaataaataaataaaaataaaataaagactgggtgcggtggctcacacctataatcccagcactttgggaggccaaggcaggaggattgcttgagcccaggaattccagatcagcctgggcaaaatagtgagacccctgtttctacaaaagacacaaaaattggccaggcatggtggtgcgtgcctgtagtcccggctactcaggaggcttaggtgggaggattgcttgagcctgggaggtggaagctgcagtgagccatgatcgagtgactgtgctccaggagaccctgtctcaaaaaataaaataaaaataaaaaaggatcggggatgtcagaaggacacggactctgaagctggaacaatctgagaaatcaaataaatcatggtggtattagattttagcccaaagaaagaagtaaatctgcatgagcccatcctcatgagtgaatgtgtattatgtatcagaaagaaggaataaaccttccttccagcttcctatattccaattaaagtagaaatctgccatggctgggagggatgagggaaacgagaataccccagtaataacaggtgcaggcagagtccacagatggatgctaaaatcagcggcaaaagggtaagggtctcaacatgttgcccaggctggtctcaaactcctcggcttaaacgatcctcccgtctcggcctcctgagtagctgtgactacactccccagatgttagtaattactgcagtggttttaacacagggccacacatccttggctctcctctccccaggaggtgaagcttccttttctctttgcatgtggactgcagctagtaagcaaaagctataccttgacagtggagtcaggcagacacttcctgccccagtgaccagggttgtccccggcaagccatgggccatcagggacccatgtgttcagcatggactccgggatgacaggatgagaaacctcacttctgtgggtttcttcccaaaacccatcaccccagtcttaacctgagaaaatatcagacaaacccaacctgaggggcgttctacaaaacatctgggcggtaactcttcaaaagtgtcagctaggtgcagtggatcatacctagaaggtggaggtgggaggactgctcgagcccaggagttcaagaccagtctgggtaacatagtgagactccatctctacaaaaaatgttttttaaattagtcaagcttggtggcgtgcacctgcagttccagctactcagggggctgaggtaggagaattgcttgagcctgggagattgaggctgctgtgagctgtgatcacaccactgcactccagccttggtgacaaagcaagaccctgcctcaaaaaaaaaaaaaagaccaaaatgttgaggtcacgaaaataagtgatcacacaccaaaagggactaaggagacgtgacagctcagaggatcccggagcagaaatgtcactggtggacaaacagaagaaattgaaacaaagtctgggtgccagttattatcatgcaccatgctctgccaggagggccgtgcggtgtgcggtgtgcagttgcggttgtggtgcccacgccacagagaattcagcaccacaaaggccgatctgggcaactcggtcccgtccaaatctccactggggttttggagaacctgccaaactgatgtcaaaatgtacctggacatttggagcacaaagacgtgcacagcccccgtggctctgctaggcggcaaggctcaacatgacactgcagggaggccgagatgggggtgtcctcagcatggggaggggccagggccaagggaggggaggtgtggctgcacaccacgctcatatggagggcacccatgtaagccctgcggggagtggaggactgacttgtttttccaggaactttaacattttttttctttgagacaatatcttgatttgttgcccagggtggagtgcagtggggtgatcacagctcactgcagcctcaaactcctccctcagatgatcctcccacttcagcctcccaagtagctgggactaccagcatgtgccaccacacccagctaatttttgtattttttgtagagacgagatttcaccatgtttcccaggttggtctcgaactctgggcccaagcacacctcagcctccctaagtgctgggattacaggagtgagccactgtgcccagcttaactttttattttgaatcagttttgaactcacaggacagttgtgagaacggcacgaagaccccgtatgcctcctgctgcagtggcctgcttctcccggcccctcctagccctgtgcacacaggtgagcctctcaccaagaactccaccttgtcaacaccgcatcctgaccaagggtgagccccgacagcccacagccatcctggggcgtcgtggcctgtgtggggcctcgcggggccccggctgcctctgccccctgcatggccccttctctctccctgtctctgcctctctctcatgtctttgcactccttccttccctggggacgaggcccaggcccatattcctcagatgacaccagtcgtcacgctgcgaggcacacgatgtgacctgcccaccatcaggggtgtcaaccctgatcgcctggtcaggacccatagttttcaaaggctcatcatccctaattctgatcatttattttagtgctcaaattggcccaggctaatgggagtccctgcaggctggctcagaatcctctgacgtggccatctgcgagatgtccagacctagaatctgccatctcccggggaaccctcactcagcttaggacacacaggcatttagaagccaggacctgggtgtccacctgctcactgccagagtgtgccccagccaccaggcccctccgcacacgggctagggaacacacacatgcctcacatgcatgcacacaacacacaatcacacacaccacacacctcatacacacctcacatacatacacaccacacaggcacctcacacatacacaacttacatacacaaacctcacacacacaacacacaggttctttctcaccttcccccttctcgtgtctgtaactctcctctctgggcagggacaaccctggcctctgttatcctggagatgttcactgacatgcccaacaagcgagcctgccacctgccctcaccaacctcctggcctcccaggctgccgctgccacaccacccccccaaccctgcttctttgactgcctggcacccccttcccaccccatccaaggggcactgaggtgggggaaggcgggaccgctgggtacccacatggaaacccagggccttcactgcacaccgtagtgaattccagctgaaccatggatctacaagggacaacagtaaagttcctgggagacatggagagaggtctctcggacctcggtgcaggaactcccggcaagacacaaaggcactctccataaggggaaagcctggcagacttgaatcaactccattaaaatgagtaactttgttcattaaagacaccattaggggccaggcacagtggctcatgcctgtaatcccagcactttgggacgccaaggtgggcagattatgaagtcaggagatcatcctggccaacatggtgaaaccccatctctagtaaaaatacaaaaattggctggacgtaacggcacatgcctcttatcccagctactcgggaggctgaggcaggagaatcacttgaaccagggagtcggaggttgcagtgagccaagatcatgccactgcactccagcctggcaacagagcaagactttgtctcaaaaaaagaaaaaaaaacgtaagaaaaagaaaacagcgacagctgactgcagctacatgcaacacacggagctcacggagataaagttgagtgagagaagtcacacacagatgctgctccttatgtctccacgcttccaaagaaaaaagcagacaaaatagtctatgcttttcagagacatacattcataaatatagcaaaaatgaggcgtgaggggctacctcctggggcatgaggggctatctccagggagagcaggtggcagcagctcagggattcagaggctcgggggccctgcgctctacttcttgactggaaggtggttgctcaggtgctcactcagccgtaatacaatgctctgaacacttgtcttgcactcttctgtgagtacattatacttcacaagaaaaaagattaaaaaacaccctgccgaggtggctgtcgaaggcacaggtgtgtccttggcatgcgggaggctgagggcgtcctcccacctcccatcaacatgaaagccatcacttccttcaagggccacttggagagacttggcttccaaacacagctgagcacaggccgggtggcggcccacaggctctagtacagtgcagacgcacctggcactccacacctgcagtttctgtccacagaccccctgacccgtggctggctctgcctgggaagcagccactacagcaccatcccagcaggaaggggaggtgccctcgaacgtcagctcccagaccgcccaccaggcctggcacagctcctgtctgcaggacagcctgataccacaaggcacctacgcaagggaccaccaagggctacattgtggctgaaaactcaggaggacacttacaaacagcagctcctgatgcacatggcctggtggggttctagaaatgaagtctactctgacaatcaaagaccaaacccactctgaggccccctgcaccagtggtgagggatctgggtcggcttggccaggatgcaggcatgaccacacggggctctgcaagcacacaggctcagggcctctgctcttcaggacaaccctggtgccttcgtcacctgcagccatctcccaggtggtaggcaccgcgtgagtctagcacagacatgttttgcagactggtgggggccagacaggcctcattctccagggactatactccacagtgccatgaaccaggcaccgagtccagagcaggagaacaggcctgtccttctggagttctgggctgtgatggtgatggcacggagttccctgaatatgacgcaaggcaaatcccaggacagcagcaggcccgtgctcaggattcctgggctggtggcagcgatccccacacaggggcagatgtcactctgatcaaggacaatagcctgctccagcatccaggcagcccaaaggaggacttgttgtcagccccctgcaggccttccctgtcccaccatgccctgtccctcccactccccatgggaaacagagaagcccctcacgcacctgcccctgtctgctgcttcctggcctacctccggcctggtgtctcagccccatcacctccacaagaccacgggggcgatgtcagaacccagccctgggctaaccctcgggggctgcccctccctgctctgctgccagctgcccagcacccagccccactgtccttcaccacactcagaggcaggccctccagggccgcagcacgtggggtctcccccaccaggactgccaggccctcttattcctccgccacctcctgcttacccagcagctgcaccagcgtgtgaagcagggccctgtgagctgggtaacctcaggatgaggctctgccacccatgcaggaggatggtgcgacagccacaggaggccaagttgtagaggggctgtggtgactgggacctgggcccatgggatagaggcagaagctcatctgaggaggggcctgggctcaatgcggacccctggccagggcgagctctgctgaaggcacaggctgacactgcaatggggacacagccatcgccatacgttcactaggctcttcccagcaggcacctggccagacagcacagcagtcacggagggtagggtcacactgtctcgggatgggctaaggcctcatgaaccatgggggcacccagaaacctgcccttgtgctaagcacaggctagaacagtggggtctgaataccaatggggacaggccacctctgtggacccttcctgctggggtacagtctggacaagtaatccccaagtgatgcgtagggtacagaacacacacgtgagctcggggccctgagggaggagactgcaggggtagaaaccacaggagacactgcaggggggaccaggtggggagatggccctcactaccacgcccacttcagaaacgcagaagcacactgctgtgggacagcactatacacccaagccctgcgccccgcccctggccactcagccaccatcttgccagccacatagccgtatgtggcacaacatcaggggctgggtcctcttgggaagagtcaggtgcattgtcataacctagtgaagggacacacacggccagggctcagctgccggaacacccagctcctagggcctccaccggcaccgtgtgtgacctgccatgctcatggcacacggcccaggcaggatgggcagtgggcagggaggccctccttgggaccactgcctgcatccctgagcctgtacttcatcccattcccctcctctcagcaaatgccctcacccctgcccagtttcccaagccacgacccagtgcccttgtgaaggccctcccaccaacttgcgcctgggctcacctcagatgtcaccagccctggagctctggcctcctcacctggcacctcctggctccagcttggagcatgaagggtccagtggagatggtggagatgcagaggcagacctgcctgcctccctgtgacaaggggctggacctgcacaccctgcccttgctgcggaccctttgctggccccttctggttcccccaccccattctgcccctcagtgggggacaccagagcctccatcagagagttcctgactcccccgaaggccatacctggctcctgcaccttggagacccacctgaggagctggcgcccctggggcagcgtctgcagccaggtcacacactggccgccgtggccatccagggtggtaaccgctctccgcgtctgcaggctccagatgtgtaccaggccactctgagacctgtttcagacaagccgagcagggtgtcagggggcagaagggtgtgctgaatgctctggggccagcctggaggccacattgtgggatgcgggcatctaggctggttgagctgaaaagccaacagctctaaatatgaactaagggccaaactggcaaagcactccttgctcctcttccagagaggggaccgggggaccctcaggagcctctaggggtaactcaggcagatctgcttctctggaggtagggggagccatgccacagtaatgcacgctgggtggtcgtgcctgctcctgcgtctgtaacaaagagtgtgtgtgtgtgtccctgcctcccccaagggacagtgtgtctgctggtgggtgctgaaagctcagcaagcctgggtggcgagcagtccatgccccttggccagcaccctcaaacaagcgctgggctccttgctagctcacgacctcctgacttggccctgggtggcctggggctggggccacagctactcaccctgagaagaggagcgggcgcccctgagcctgggctccttcgcagaagtgcagcgcatgcaccggtgactgggtgcctcggaggacaaactgggggtctggaggtggcggcgggcagggggccgtcatgctgggcaggatgcagttacctgggcaccaagggagggcgtgtgagtgactgcgtccctattctcaccctctaggaaggctgctcaggcacaggggtgcttgagatgttgcccctgctcattgtctctggccctgtgcccctcctgggagagaggtgccactgctccccagacactgatgaacggcctgtggctacagaggcaccagttccctgcacggcggtgagcccagcagagagcacagagctcacccttcccccactgctgggggaactgggagccccatggatgccagccctcctcgcaccgtgcctgttggcctctgcacctgactggtgcacccgcttgggccccacctgagccatccctgagtgggcacagcggcatccaacacttcctcggccactctggcctccagggcttcctgtccaccactggctgtgccctctggctccccagatcccaggggccacaccagtgctttcccactctggccatctgcatgccgggactgccggtcctgccactgggcttggctgagtcccgccctctgtccagggctcactccagtgtctctcttgggagccaccctccctccctgctggcaaatccagtctcccttcttctctcctccctgctgccacctctgcccatggccagctcagggatcaggggaaaagaggcacacagggtcccggggggctgctaggaggagccttcctctcacatctgctgggccccaggcctgccccgccacaatttctaaccgctatcaccaccctataaggcggcagcacccttttcactcttggggaaaccgaggcagagaatagtcactgagctgcaccaggcccctggcgctgaggcctgaagtactctagggcctcatggcaccactgaagggcagagtggctggggcagagtcgccgtgcggctccttaggagagctgcggtcacagatgagcagctgttccccagaccactgggcctgtgggggaagactgccgggccaccacccacccagagaggcttcccgggtccgtgccgagcccttccaaccactcagacccacagggcctcgcactccacctcagccccacagctggctgctctgtggggtggccctggagccagaagcgaccagctccatgtctgtctgcctgcagaccctgagctgggctaagggctcagagggaaaggccaggagcagaccactgggtggctggggcagcctgtcacagggggcctttcccactgggctctgggacagtggggcaggccccggcccagccacctgcagcctgcacacaaggcagggaggatggcccacggcagccacagccagcagagggactggggccagtaaaggaccagggcaggggagatgggaaggactcttcagaaggggctgggtggtaggcggatgggggtgcaggttcagaggcaggagtgctgtggatgtctggaggcagctgtccagggtgccccttcagcagcactgccaccgccaagccctgcctctccccttctgaatacacgccagccctctccttactctattcagagctggggcaaaggttcaaaacacctgagaaatgcccctgccaaggtgtcctgcagagtggagggtggacagcagccagtgcccaagcgggcggcatgggggagggcaggaggcctgggaggggccgggcagtgactccagggcgcaggtccaccctgcctggcgagagacctcgggcagccactctacctcccaaccctgcctctctcaaggggttccgaagacaatgcggagttccctgggatatcctttactaactgccaagtcccatttttccttttcttttttgagggggatgagagaggtttcgtcctctctcacctttggctgaaagccaactgatcatgcccaaacttaagggtggcttccaggggaggcagagggaccagaccccacactgctcccaagacccacggcccctgctccagcctgtgatggggaagactccaagactcctgaagacgcagccaggccgggggctggaacagctgccctcagcgggctggcttggaggacagttctcagaagccactgcctgtttgtgctatgcctgccaggtaagaaaggcaagctagccagggggacaggaaggcagggcccagctccaagaggagccaaagaatgcagacccggcaaaagcacctccacctagcaggaaagcaccgagtccaggatggagggtccctcccatgactccagtccaggaagcagagcctgacaggtcacctctacacaggctcccctgtgcagtccaggcacgaacacacattagacacacgctatgctcacacatacacacacatgcacatggtgcacacagacacatgcaaaacccacacataggacacatgcctacacatacatgttcacacacccatatgtgcacacacacacatgcacacacacaggcacacactcatacctacatacacatacacacacgcagactcagacactcaggcacaggcactcacgtatgtgcacacacagcacagagaagcacacacacagacagcacggcggccttgggcggtgccagccgaagcccggcccccacatgccacctgcctggggcctggcgggagtttccagaacctcaccagcagaaggctcattctcaggtgatgaaatcaagttctcctctattgtttccccagaactgcagggaacaaacccgtcacgttgttacaacaaccaaaatgcacaggccaaaatgatgcatcggcaattaagggctccatcatttcaagtaattaaaataaatgctttatttgaaaactaattaattctagctacatatttttcccatgacaatatcctaggattgcttgatttatgacatctaattattctttattaatctaattgagaatcatcacattcccctatcttgcctggccccaggctgtggagcaaaggccgcccttgcgcaaggcccgtgtgcgcccagctgtccttgcggtggccccggcccagccccggccctgtcctcccggaggcaaaggaacaggaaacttaatccacagagcacaactttggcttctgcctgctcttccaggtgtcaaagtgagccacattctttgaaaaatgaaaggcagtctgacacaatttgtgcaactctaacagcccttccagagaagccacaaacacccctgaaagccccagggaacaaatggacgacaacagcatctgcctgcaatgcaccaccgcggaggcagctcggcaggccccagggctctcccaagaggggtccagagcgctcctctgggtgtggggaccagcgggtaggtgcaactggcagagaggtccacagacaccccactcaagggaggcaggggcaggcctgcaaatgtcctgctggcgcaaacccacccacacctgcagggccttcctccctacagatgaagcagggctgcggcagtggctggagcccaaacaccacaggtccctacccaagacattcttgggctcctgggggttcatgccagacaggcctcagctcagcctgggcccccgccctgccctcgggctgcacagccctgtgctcagtcccctagcccttttgtggaaatcagcaaagagtaccacgaagtgagccaacgtggggagccaccacccagagaggccactggcaccacccctgcccaccccagcccaccaggtcctccctgtcccattgggcatgtgacagcacaaggacaggccgcacaggccgctgggagtgcctcaaacaggaccctctgccccactgcatatctcacacaagggcatggaactagctccagcatcccccgaggaagctccagcccataatcagcaagactgaagactaggtcagcacccctttacaccaggacggacaccctgggtggccctctcccaaaaaacaactaaagatgttgataaaagtttcttagaaggccaggcatggtggctcatgcctataatctcagcactttgggaggccgaggtgggaggattgcttgagcccaggagttcaagaccagcctgggcaacatagggagaccttgcctttacaaaaaataaaaataaattagccaggtgtggtggtgtatgcctgtggtcccagctactcaggaggctgaggtgggaggatagcttgagcccaggaggtcaaggctgcagtgagccatgatcgcgccactgcactccagcctgggggacagagcaagaccgcatctcaaataaattaaataaaataaataactatctttaaaaaatttttttaaacacagccaggcacagtggctcaggcctgtaatccctgcactttgggaggccaaggcaggaggattgctggagtccagaagttcaagaccagccagggcaacatagtcagacccccatctctacaaaaaaaataaataaattagctgggcatggtggtgggtgcctgtaagtccagctactcaggaggctgaggtgggagaatcatttgagcccaagagttccaggctacagtgagccacaatcacaccacggcactccagcctggacagcagaacaagaccctgtctctgaaaaaaatcaaaatcaaaatcaaaatattaaacgcatcactaagttgacaaaaaaaagtctgagctgccagaggccaaacactaagtaaaagtgcagcctcgggagacctgccaagcctgccttgagggcatttgctgcactagtgacctggatttccagctctgatggcctctggggtgacaaaaggcaaagcttagggccatcctatggtggctaacctcctaggagaaccccagtagctagatgctcagtgttaggctgagccagcactaaacctacacccacggatgccagaaaaacaccagtcctcaggtttcagccctaactcacaccaccttgagagatcccccacacttcagtctgtcttctcagaaggaacccacctgcaacccaggcctcaaggaattcactttagaataagtcctaagaagtgcaaggttgtagtcaaaaatcacaaaagtcaacaaggcactgtaatcgagagtcatgagaggcaacaaaaaacagaactagacccacagagcagagcactcgggtatataaggcaagggtgcttaacgctcttaaagaaacagagagggaactgcaactacaagtagagagcaagggagatgaaacatcatcacacagatccaaaaaaggatccaacttggtgagaggtggttgggaaacaggagatgtgtgttgcgccaaggtattactctccaaactgtttactgatcacaaaaggaaaatgtgtatcttcaatggagacatctggctgtcaccactttcaccactgagaaaagctagcactgccaataatgaacaaactggcattgcttatctcctgatgtgatgccacagacatggcaccaaccttgtgtgtccctgccaacaatgctcaacctcaatccagccataaaggaaacaatcagacacatccaggttacgagacactgggcaagactactagcttggactcatcaaaaaggtcagcatcaagagaaacaaccaaaggaaaacgctgggtaacttccacattaagagaccaaaggggcatgatgaccaaacatgacatataaaccttagatcctggctcttagatcagatcctggatcaaaaaaaagggggctataagggacatctgggggatctttgtgggtaatctgaatatggactacagataatggggtgttattaatttccttggaaggataacagtattttatgtagaagaatgtctttattcctacgagatacatccgaaagtatttaggggtgaaatgctataatgtctacaatctgctttcaaatgtttcaaaaaaaattctctcttaatctctacctatctatgtatgaatatataggcagagaagtagtacaaatgtggcaaaatgctaacaactggtgaccacaggtgaaggtgtacaggtatttattttactacacttgcagcttttctgtagatttaaaaccataaaagcatgccagaggggtggagaaagacaagtccacactggactcgtatccagaatatctaaagaacacagaggtcaacagaatacaaaagcaaacaccgaaagaaaaataagcaaaaggcttggacagatatttcacaagcaacgtaaatgtccaataaatatatgcaaagatgtttaacctaattaataatcctgggaatgcctgtcaaaactacaatgtgatataattacactctcagcagattagcaaaaaattaaacagtctgtcaaatgttgatgaagacagaggacaactggaaccttctaccatgctagaaggagcgcacacggaaacgaccactttggaaaacaatctgactccatcttgcacaccgtatgactcggcaaccctactcttagataaacaccctgaagaaattctcacaagtgtgtacaaagaaactcacacaagaatgttcctagtagtattgggtataataacaaaaaccaaaaacaacccaaatggctagcaactgcagaaaggaacacattgggtaaattcgtacgatagaatactccacagaactgaaaatgaatcaactccagtcttacatggatgaagctcaaagtcataattctcatcaagagacatgaagggagtcaaaactgaagacacagacagaaataaaatgttcacaacacgtatctgttcaaggattcattctcagaatttactccttgactcagaatatgtcactcaataagaaaaagagtgtaacacaaagtaattccaaaacgctaaaattagagatgggcaaaaaggtatatggggcaaacagaaacaataagaaagtaggggttgaaatactaatagcagacaaagttgaattccagccaaaaagcattagacttgacaaagacagatagtttttaattcttcattgcagtttacaaaatataacagtttattgccaggtgtggtgggctcacacctgtagtcccaacactttgggaggctgaggtggaaggattacttgaggccaggagtttgagaccagcctgagcaacatagtcagattccatctctcaaaacaaataaaaattcgctgggcacagttgtatagtcccagctatttgggatgctgaagaaggagaactgcttgagcccaggagtttgaggctgcagtgagccatgatcacaccactgcattaaagcctgggtgacagagtgagaccctatctaaaaaaaaaactatatatataacagtttttaatatctatatataatatataattaatctatgtaacagtttttaatatctatgcactatataacagagataccacctctatagagcagaaacgacaggagatgcagagtcacagaaagaagcctactagtgattggagaatatgacatactactctttttcttttttttttttttgagacagaatcttgctctgtcacccaggctggagtgcagtgacgtggtttcggctcactgcaacatctgcctctggggttcaagcagttcttgtgcctcagcctcccgagtagctgggactacaggcacacgccacagtgcccggctaatttctgtatttttaatagagatggggtttcaccccattggccaggctggtcttgaactcctgacctcaggtgatctgcccatcttggcctcccaaagtgctgggattacaggcatgagccaccgtgcccggccataacatactactcttagtacaagtcagatcacgtggacaataagtaggcagatagaagatccaaaaaatacaaccaacaaggtagatactacagatctataatggaactttacactctcataacagagcctacctcttcttctcaagggtacatgggacatgtataaaaattgactgtatattgggtcacaaagaaatatcagtaagtttcataaagaagaaatatttataaataaaattccatgaccacagtgcaattaaattagaaattaataaaataaaaaacaaaaaggtcttatcaaatagaaatttaaaaacaacttttaggtgaaatgggataactgaaaccacaaaaatttttttaaaatgaaaaatactacgtaccaatttatgagatatatttaaagctctgatcagaagaaaagtatagaccaataccagttatgactatcacacaaaaatagtaagtaaaatattagtaaacaagacccaatatcacattaatatacagtgatcaagtggaatttatcctagaaatgcaaggttggttcaaatagggaatttatgaaagccatatactgtattaatagatataatgagaaaaagcatgtaattatctccacagatgctgaaaaagcctttgacaatattcaatgcccattttttattaaaatacgtaaacaaacagacattgatgcatttcttagaggttaaatatatatatatatatacatcccccttggtcctaaatccaacatattattttatgaagaaatattggggacattcccactaagatcagaatgcctgctatctctactaccattcgacattgtagtggcagtataagccaaggcaattagtcaagaaaaattaagtagaggtttataattggaaaagaagacattaaactatcttcctgttgagtatagtggtacacgcctgtagtcccagctacttgggaggctgaggcaggaggattgcttgagctcaggagtttgaggctacagtgtactatgatcacacctgtgactagccattgcactccagcctcggcaacacagcaagaccccatctctagaaaaagaaaacaaaaccatattccagattatacgatggtatacatggaaagccatagaaaatcaatgataaaacagattcaaataataaaaaaaaaacttcaactggtagcaggatgtaaaactaacatagagaattcaatagtctctatgttatttgtatacaataacaataaagagcacatattacttgtacaaaaataataaccagttagagaaaattccatttataccaaagaagataaaatacttaagaataactttaataaataaatatgaaaaacctacatgaagaaaatgttaaaattctcttggaagacacaaaagtagatttgaacaaaggaaaaaggatcctttgttcttggttaagacaattcaacatcaacataaagatgtctcttctccccaaattaatttataaatttaacacaaccccaacggaaacaccagcaagcttctttatggagttagagaagttgatattaacactcacttggataaacaaaaatgtagcatgcacagaaaaacatggggaaaaattagctgcaaaggagctagccctatcagatactaacaggtactcaagtctttaggattaaaagtatagtactcctgtatagacagatggatcagtgaaatagaaagcctagaaataaacccaagtacgtgtggaagtttaatacataaaagaggtggtatctcacatcactggaacaaaaatggttaaccatataaaatcagatccatatcttacagtgaaatacacgagcataaactccaagtggatctgggatccatatgtaaaaaataaaccaagcactagaagaaaacatggaagaactgcattattaacatggttgtggaaaaggtttgtcatgactcaaaatttagatacaacgcctgtaatcccagcactttgggaggccgagacttgaggtcaggagttcaaaaccagcctggccaacatggtaaaaccccatctctactaaaaatacaaaattatctgggcgcggtggcaagcacctgtaatctttgtacagctactcgggaggctgaggcaggagaaatgctttaacccaggaggcgaaagttgcagtgggcccagatcatgccattgcactccagtctgggtgagaaagtaagactctatctaaaaaaaaaaaaaaacaataaaataaaatggataattctgactatagaaaaataaaaatttttcatgcctgtaatcccagcactttgggaggctgaggcgggaggatcacaaggtcaggagatcgagatcaccctgactaacacggtgaaaccccatctctactaaaaatacaaaaaattagctgggtgtggtggcaggtgcctgtagtcccagttacttgggaggctgaggtaggagaatggcgtgaacccgggaggcggagcttgtagtgagccaagatcacaccactgcactccagcctgggcgacagagtgagactctgcctcaaaaaaaaaaataaaagaaataaaaagaaagacaaaaattttagcatttgcatgtcaaaagaaatttaaaaattaatatctttaaaatataaataaacttttcaatattaaggaaagcctaaaaactcaatagaaaaatgggaaaaagagatgaatagacaattcagaaaaagctatgaaaatgcccattaaacacatgaaaagatgttcaaccaaaagcttactcatagaaaaatgtaaattaaaactacagaaaagcttcttgttctggcaggatgaagtaagctcattacagcctctctctcaggctgactgcaactcaaaactctggacaaaatataaaaagcaactacctaaggctgggcacagtggctaacatcattaatcccagcactttgggaggctgaggtgggaggatcacttgaggccaggagttcaagaccagcctgggcaacatagtcagaccctgtctttacgaaaaataaaaaatattagctgggctgatagcgtgtgcttgcaggcctagttacttgggaggctgaggtgggaggatcacttaagcccaggagttcaaggctgcagcgagctgtgattgtgccactgcactcctctctgggcaacagagcaagattctatcccaccccccaaaaaatcccaaaaaacaattctctgaaaacagaaaagtgggcaacagcagccagccgggttttggaggaaagcaaagcttaggacagtgacctacacagagacatgtttcctaggttattcgtatgtgtgttttggggtgctgccctacagttggccctggttgcagagctaccaggcagcagtggctaaaacttggataaaactccaaatttctagatagagatacagagaaaaaggtgcgctacggccccaagaatgtgaggggaaaccctgaaggtttactgtccccctctctcacggtgctgccccagggatggccctgcacacagagcccaggggaaagtgactgagagagaagcttgtctttctgatcaggggaaccaaggaaagggaaccctgcaagatggcaaggggggaaactacagagtggggagagctaaaaaaagttccccaattctgtgaataaatacacagaagcctcaagctcacccctgagctgtgtatacacagggcagacccaaagcagcaccagctgtaagaagggaagtaaaccaacactcaagtctcaggctgagccctgggtggctgatgtgcgagacagaaccaaagcagcatgtcaaaagctctgaaaataaaaatgagattaaaaccacagcccacggagggcgagatggagcttgtgcaaatctaactgggttgactgcctgctagcgccaaactcagctctctctggaggacctcacacactattcaacccaggatatgtctaggatatcatccaaaattattcagcatacaaagaacccggaaaatgagaccaactctcaaggaaaaagccaatttacagatgccaaccttgagaagattcagatgttggaaatatctggtaaaaattttaaagcagctttatgattatgctgcatgaggcaaaaataaacatccttgaactgaatggagggaaaagacctctcagcagagaaatagaaattattttttaaaaaaccaaacaaatacgaatttcagaactgaataatatctgaaaaaaatcaataatggaatgggagatgacagagtgacataaagtgggccaggcgtggtggcttacatctgtaatctctgcactttgggaggccaagacggaggatggcttgaggagttcaaggctgcagtgagctatgatcgtgccaccgtactccagcctaggcaacagagcaagaccctgtctctaaaataaaataaaataggccggacgcggtagttcacacctgtaatcccaacactttgggaggctgaggcaggtggatcacttgaggtcaggagttcgagactagcctggccaacatggtgaaaccctgactctactaaaaaaatacaaaaattagccaggcatggtggcgggcgcctgtaatcccagttacttgggaggctgaggcaggagaattgcttgaaactgggaggcggaggttgccgtgagccgatatcataccacggcactccagccggggcgacaaagtgagactccgtctcaaagagaaaaacaataataataataatataaatataaatataaatataaaataaaagattgagtaagtgaaattattcaatataagatcagaaagaaaaaagattgaaataagtggttagcatagcagggacttgtggaataatagtaaaaggtctaacattaagggcagtggagtctgagaagtagaagagagaaacagatttggacccaaaaattaattgaataaataatgcctgaaatttcacaaacttagagaaagacaaaagcacatatgtttaagaacatgatgaaccataaacgaaccataggataaattcaaagaaaacaatattgaaacatcataaactgctgaaaaataataatgaaaccatggaggccagaagggtggaacatctttgttaaagaactgaaagaaaacaactctatatctagcaaaatattctttggggatgaaggcaaaataaagattcccagatgagggcaaatgagaatttcttgcctacagatctgcactaaaagaaatgctaaagttcttcaggttcaaaagacatgataccagaaagacatgtggaacttcaagaaggtaggaggagcaatggtaaaatgcggttttatcacttcagtaaacatgtatgattgttaaaattgtattatctgttgaggttttcaatatggcagttataacataatggaggagggtaagggacctatgtggttgtaagccttctatattttatttgaaatggaaaaatattaactctaagaagactgtgaagggttaattaagtatgtacactgtcatccctgcagcaaccattaaaaacataacacaaagagatactgccaaagttccaacaaaaaatcaaaacaatgttttaaaatacctaaataattcaagagaggacaggaaagaggggatagaagaaaaaaaaagaagagaagaaaaagagaaaacaacaaaatagtagacctaaatataaccataccaatcactacaataaacataaatgctcccaacatgctaattataagacccaactataagctataaaaaataaaaaggtgaaaaagatatgctatacaaataataaattgcagtggatatattaatatcaggcaaagtagacctcagagtgaggaatattatcacggacaagaagaagatacaatgataaatggcatcgattcagaaagaagacacaaaagttgtaaatactgagctaataagagaacttcaaaatgcatgaagaaaaaactgatggaactgaaagtagaaatagataactacataattataggtggagacttaaactcctccttagtaactgactgaacaagtggtcaggaagtcatacagaagacctgactaatactatctacctacttgacctagttgacatttatagaacatgccgctcagtagaagaaacacattcctctcaaatgcacatggagcactcatcaagataggccatatcctgggtcataaaagaaaccttaaaaatgtaaaaaaaaaaaaaaacaaacaaacaaacaaaaaaaaaacctcacgcctgtaatcccagcactttgggaggtcgaggcaggcagatcacgaggtcaggggttcaagaccagcctggccagcatggtgaaaccccacctaaaaatacaaaaaattagccaggcatagtagcgcacgcctgtagtcccagctatccaggaggctgaggcagaagaattgcttgaacccagctggcggaggttgcagtgagtcaagatcgcgccactgcactccagcctgggcgacagagcgagactctgtctcgataaaaaaaaaaatgtaaaaaaacaaagtatacaaagtatgctctctgatcatatggaattaaactggaaatcaataacagcaagataatgaaaatctccaactatttggaaattaaacaacactgttttatataatcaatgggttcaagaggaagtcccaagggaaattagaaaatatctaaactaaatacaaatgaaaacaccacatatcaaaacgtgtaggatgcagctaaaacagtgcttagagggaaatttacagcattaaatacttacatcgacaagaagaaaggtctccaaatcaatgacctggtttatgccttaagataacagaaaaagaggacaaagtaagcccaaaacaagcacaaggaaggaaataagattagagcagaaataaatatttttaaagaatagtaaaacaaatgagaaaataaagcaagaggtcggttctttaaaaagatcaataaaactgataaatctctagctgaactgacaacaataaaaagagaagagacaaattataataattaaagaagggttatcactacagacaccagaaacattaaaaggataaggagatactatgaacaactcaaataaattcaagctaaataaacctagctgaaatgaaagttggaagacacagactatgtgaagaaagagaagacctgaatagtcctgtatcaattaaaggaatcacatttttagtttaaatccttggggaaaaaaaaaaatcaaaattccagcccacatgactttactggcaaattctaccaaacatttaaagaagaaataacactattctacaaattattttcccagaaaacagaaaaagagagaacatttcccaactaatttgatgaggctagcactaacccaataccaaaaccagacaaagttagtagaaagagaagaaaaccacaaacaaacatatttcatgaatatagacatacaaatcctcaaacaaaataatatcttgctgcttaagtctcaagttggggagggaaaaacagcaaatctaatccaacagtgtagaaaaagaatacactggagccaactggcatttatctcaggaatgcaaagctgattcaatattcaaaaatcattcaatgtaaactctcatgttaacactaaagaaaaaccacaggatcatataagttaatatagaaaaggcactgggcagaattcaacatccattcatgatttttaaaaaaaccctcagaaagcataatccataagataaaaaacacaaattcaccttccacaaaattagaaacctttgctcttgaaaagagattttttttttttttttgagatggagtctcgctctgttgcccagactggagtgcagtggcgcgatctcggctcactgcaagctctgcctcctgggttcacgccattctcccacctcagcctcctgagtagctgggactacaggcgcccaccaccacacccggctaattttttgtatttttagtagagacggggtctcaccgtgttagccaggatggtgttgatctcctgacctcgtgatccacccgcctcggcctcccaaagtgctgggattacaggcgtgagccaccacgcccggcctgaaaagagattattaagaaaatgaaaagacaatctatacagatggggaaaaatattttcaaatgatgtatatggcagataatttatataccaaatatataattttcaaaatccacaaggaaaacacactcacaaaataaaaccactaagaatgggcaatagatttgaacaaacacttcaccaaagaagatatgcaaatggcaaataaggacatgaaaacatactcaacatctttagtcgctaggaaaatgtaaattaaaaccacaataaaatgccattacctacttatcagaatggctaaaacagaaaagactgaccattccagttgctggaaagcttatgaagtaattgaaactctcatacgctgctgatgggattataaaatggtacaaccccttgggaacaaagtttggctatttctttaaaaaccagtcacatactggagacaacccaaatgcccatcaacagcagaagaaacagagctatatccacacctggatatatccatccttgacaatgacaaagtaggaagtactgatacatgctttaatgtgaataaatctcaaaataatcatgtcaggtgaaagaagccagaaaaagagagtaaattctgtgattctatttatgcaaaattctaggagatacaaactgacctacagtgacagaaagcagattaaagggaacctggagaagagaggtgcagggaggaagaagggaggggcatgcagagacgcaggaagatactttaggcacagtgggtatgttggttgtcttgagcgtggggatggcgtcacagacgccgcacttgtcaaactgtccacttgaaatatgtgcagtttattgcatacgcaatttaattgcacaatctatttttgtgctcattaaaggaaatgcaagagcaactaaacaatccaattaaaaaggcataaaagatttggccaaacactccacctaaaaagatgtgcaaataagcacaaaaggcaactcaacatcatagccattagggaaatgcaacttatgcccataatgaaataccactacatacctactagagtggctaaaattcagaaaaaaactgtcaaaaccaacaaaaccaagtgctggcaatactgtggggcaactggaaccttgttggtgaaatgcaaaatggtgcccacactctggaaaagagtatggcagtttcttatttatttatttttttatttttatttttattttttttttgagacagagtctcgctctgttgccaggatggagtgcagtggcacaatctcagctcactgcaacctccgcctcccaggttcaagcgattctcctgtctcagcctcctgggtagctggattacagacgcctgccaccgcgcccggctaatttttgtagagacagggtttcaccatgttggccaggatggtcttgatctcctgacctcatgatccacccgccttggcctcccaaagtgctgggattacaggcatgaaccactgtgcccagcccagtttcttataaaattaaatatgcattaacatgttgcccaacaattctactcctagatatgtattctagagaagtgaaaacttatatgcaaacaaaaacctgtacatgaatgtttatagtagttataactaaccacccaaaacagaaatgtgaaaactataatctcctaaaacagaaaataacccaaatgaccatctatggatgaatggaatactattctgcaacagaaaggaacaaactattgataaatgcaacaacgtgggtgaatctccaaagaactgagtaaaaggctacacactatttatatggcatcctggaaaaggcaaaagtataggtacagaggacagaccagtgactgtcatggatcagaaggagggggaggggatcactgccaaagggcagcaaaaggcagggttttgagagaatgagaagttttctgtgtcctgattgaggtggtgttgacacagacatgggttaggactcactgtaagcgcacacaataataaagataataacaataatacagtagttccaccttatctaggggggatgatgaatgatgatgatgaaaagtatctagggatacttttcaagacccccagtggatgcctaaaaccatgaatagttctgaaccctatatacaccatgtttttccctacagtgtacatatatacctacgggaaagtttaatttaaaaattagagacaggcacagtggttcatgcctctaatcccagtactttgggaggccaaggcaggaggatcactgagcccaggagttcaagaccagcctgggcaacacagggagaccctgtctctacaaaaaataattagctggggcagggcacaatggctcacacctgtaatcccagcactttgggaggctgaggcaagcggatcacctgaggtcaggagttcaagaccagcctggctaacatggtgaaactctgtctctactaaaattacaaaaattagcccaggcgtggtggcaggtgcctgtaatcccacctgctcaggaggctgagacaggagaatcacctgaacccaggaggtggaggttgcagtgagccaagatcgtaccactgcactccagcctgggcaacagagactccgtctcaataataataataataacaataataataataataataataagccaggtgtgttggcacatgtctgtagtcccagctactcaagaggttgaggtggtaggatcacttgagcccgtggagtttgagactgcagtgagctatgctcacaccactgcacttcagcctaggcaacacagcaagatcttgcctcaaaaaaaaaaaaagtatactatgataaaagttatgtgaatgtggtctctctcttacaatatcctgttgtattgtactcacctattttcagactgcaattgaccatgggtaactgaaacctcagcaaaagtgtagatgagaggggagctagtgtcgtaataaaatgcccatgagtccacactgaggtaaagaaatgactaaataaacaaatctcccaaacagaagaattccactttatgcagacactctaccatcaaggaggagtagataactcccaaccgtttaaatatgggttatgcagtgactcccttcctaagaggagagtacggaaaggagagaaaaacagccactttacagcagaaacacctgacagataccacctccgccaggtgatgacgctcagcatcagcagggctaggtcatgctgaccacacgtcccactgacatgatagaaaatccaggaatgggccaggtgcatggctcacacctgtaatcccagcactttgggaggtcgaggcgggtggatcacttgaggtcaggagttcgaggccagcctggccaacatggtgaaatgccgaccctactaaaaatacaaaaattagccaggcatggtggcacgtgcctgtaatcccagctactggggaggctgaggcaggagaatcgcttgaacccgacaggcagagattgcagtgagccgagatcgtgccattgcactccagcctaggcgaagaagcgaaactccgtctcaaaaaaaaaaaaagaaagaaagaaaaagaaaatccatccaggaatggcattcaacctttgtgcttttcttcccaaaacccttaagctcagtctaatcgtgagaagaacacaacaaatcccggtggaggaacattttacaagagcctgaccagtgctcctcaaaacttaaggttatcaacaacaagaaaagtctaagaagttgtcctggccagaggagcctggggagacaggagagcaaacgcagtgtggggttctggatgggattctgcaacagaaaaggacattagggcaaattcaggaaccctggatgaagcctggactttggtcactaacaatgcatcaatcctagtccattagtcatgcgcagagcaagatgctgacaggaaaaagggctcagaaatgcgtccgtgcacaaggttcacactcaaccactgctcttggccacagtctcacaggttatgtttcaaataaaatatattgtacaagattcttgtgctattttttcttgtgttacagttaatggtatttaatttacactaatgtattatgaaacttcaattcctgtttctggctttggagtcaatttctatctctactcaaggtgacttaaacagacttaatgagcctgggcaacatagcaagacccccatctctacaaacaaataatttaaaaaaatcggccagttatggtggtgcccgccatgatagtcccagctatgttggtggctgaagcaggaggagaggatcacttgagcccaggaggttaaggctgcagtgagctatgatcacactactgcactgcagcctagcctaaagagacctgcctctaaaataaacaaacaaaacagacttaatgtcaacttttacacgcttttcccattccaaataatttactatcttatttttgccctaatataaattcatcaacagtgccccctggtacaagctagtagttattcggttaagcaaatgagctgatgacttttatgaccatcgttacttccagaaggtgtccccagccagctggggacagaaagagcactgatctaaccactgttgcgcttcaccagcccagcccacctaatttctctatgaagtagcacagccgttctagcatgaagatgttgaattggctggtcctccaggccagcaagaacatgaagccaaggccatgaggcctgaggcaggcacacaggtggctggtgaatgggctccctcccacctcctgctcatcaggcacctcccaggctacacctggaaccagaaaggcactccctggacaggcctgtcctgagcagagacctcagtgtcatcccctgccttcctggtgaggaagacagcagcagtaaggcccagaatctcagaactgtccgctgcattgcagcctcagccagcgaccctgatctcccaaaaagcctcacacacaccactccaagaagctgcatcagacacagagccctgggctatcccagtcagttcactggcacacatctcagtgctgctgcttcaaaccaggaaactgaggtctagatacacccttccccatctctgaaatgcagggagatcagcggggagtcagtgggggcagtcagagactagcccccaacaacccttctcagtcactgatgtctgcccaccaaggcctcgggggccaggattgcttccatggccttggctctcagcccaggacgggggtgggagcagcctggtgagtaatgcccaggcccccaagaggtggtcctgccataaataatgccaaggacacatcccccttcaagggaggccagacctgccagggagggctgcagaaaagctgcactctagctgcaaacaggaagggatgagcctgctcagatggtgaggtccctatcctgttacctgccactcacggccacaaaggaccagaaaccctccctgggcaaggaaaacatgctgcacctccctgtttggacccacggctaccagggccagctactggagataccaggactctgctagtgtcacctggcctgggaaggacctaagcagctcaagctggccacacagcagccacagccctggccatggcccccacctgcccactcccactgcagccagctccctgtcctgagcacgggaaacaggtctaccagcactaactcaaacttcacaaagaaaccatttctggaatggggctccgtttggcgattcggagtcaaaggcgcacttcatagctcctttccaaatcccgtgcattgtcaggccctgttcccctttgaagcctcgctgagtgattgaagcgtctactttctgaggggcagatagcaccgggctggtaatctgactctaagccacgggataaaggtagtttgtttcctctcagcccgtctgtcaacacctcctcagtaattagccctaattattacagagggccagcctcccattcggttattaaatcagaaatagtatcacggctgggcatctgtcaacgccccgactggcgaccttcgattcattgaatcctctgtcagtatccgcctttggaagcgcccaggcgggcagggaggcagcggcttcaaagatgcagatcccaggaagaattccggtgaggcagggaggcagggagggccggtgcccagcagcccgatggcgagggggagccaggcaccgccccccgggcagcaagtgcacagcccaaccccagcaatttcccacctcccagggctgaccgatgtcagtctctctgtggcggggaataaggtatgccccccaagaactccttcccttggagaagaaagcacctccaggcctgcatcaggcatatccgtctcagggagtggccctgactgacaacttggcctgaggcccacaaagccctgaaccagctcagtgcagggaggggaacccgagccccggctgcccagagcactggtaagctggcaaatctgcaaagcagaactcagattccagccatagacacgatttccatagtggagatgagagtgctacagtcctgtaggccccgacgaaggacagccacccatctcccttctgggtctgagtctgttctccatcctagagaaatggtcatttgctctgccacaggggccttctgctctggcaaagcacctccaccctgctcccctagggtatagctgccccccagcaagattcactgcctcaggccaggggccggcactgacctcacctcacctggggcagtggcccaggtgccccagggctggccaccagcacttctccagagactgagacccacagtgccccacccaggactcctggcctgcagtgagccaggtggggcccagcacggtgcctacatgctgaaccccaccaggtctgtgccgcccccttccagataggccctgctgcgtgtgagggagggtcccagagatcagtcacttttgctggggacacgcccaaatggcgtgattcgttcccgagcagagacaagcaagttcctctagacagcccactgcagcctgttctcccccgaggcactgccagtccctgctgggtgctctgccagcactttgggtcctcgtggccaccaaccacccaccacgctggcagggggagtgggtctcatggagacaaggacatggattagttttcttccttggggatgcctggaagcctcatggctggggcatgaggagtgacctgctggccagctccacagtcagcaggggcgccaggcaggcgctgaggctgcaagtcagacttctcctttgcactgggacacgggctgcctcagctgagccaagaggaaatgccagcgtgaggagccaccaggctgcagaggcaggcaggatgggcaggcggggtctctctgtgagcaggcatctcacgctgtggctggggatgtccgtcgccccaggagcgggtcccaggagcctggcaagatggcaggaaggaagcctgacttggacattgttagccagcctgccccaggcacttacgggcagaggcaggaacccagccagcagagggaccggcctttttgacccgggtgaacacacggaaaagctcactgctttacaggaagcgtgacatccccgtgcaccagttcagcctctgctcagaggcctggttcatgtaggccagctgccgatcccatcagggagagacaacactcacagagggtgcaggatggggaccaatcccctggggctggtgcccctggcctcggggatggggatgtgccctggaaacttggtcggagctggaggaggggtccctaagcaagctggggctgacactttctgacagggacttgcctgtgtggctcctcctgtggcggaggcaaccttgggtggaaaggggaggtcccctatcacacacaggtggtggtgtggccaggtgtatgtctcatcaactcccgaccacccagctgcatgcagtcagctgtgcacatgcttacatatgcatgccagcaatgtgcttgcccacatccacagacatgcgaatgaggacagaggccagcctcccactcgctctgccctgtgggtgctgcaggtggacccctcactgagggccccccctatgcacagcctgtgaataaagagccctggctccacaacccacaaacactccccagtcccctgcagtgctcagacacagaggtgaggtgggcagcgcaggcacagcagggggcaggggagtcagatgtcctgtgcacccagctggcagccccaccaatggggacacagaagaatgtggcaagtgcatgagcacccatcatccacaggccccagccctgtgctgggggtggttcctgaggccaggaggaaaggagccggccaatgagaacaccccacaggcctgggctcttccttggccagcccctacccaccgtgtccctgtaatagagatgatgtagcccaaagaaaaactaagggagcaacgggccctgctgtcctggagagcaggcttggccaggctgtccagcgacaaggcacccccgaggcctgcaccaggagagtgtgaacactgctggggctgggcaagggccatgacaccatcctcgctgcctctgcatttgtgatccaatgtgttttaaaacttgcaaagacaacttgaaaaatggggacatggatggtttccctatgacataagcaagacttaaaagctagaataactagtaagggacagatcagaccagagagcaggcgggtaggccaggcatggctcacgggtggctgcagccagactgtgagttgctgcagccagcagctgatgctgaggtaggccctatggaaaaaggtgaaatgggatcccctgttggtcaggacataataggttatgctgtggaaaacacaagccccaaactcagtggcttcgcacatcaaaaatttatttcttgctcatattacatgtgcatcgcggtcggcagaggggctctgctcatcacaggctatcaaggatgacagcagacccctcccttctgccgcagttacacttacaggtggactcaaggttgaatgtcaaaggcagaaagttacaacctgggaatacaggataatgcctttgtaccccccaggtagggaaagatttcttaagtgagaaacagcatcccatacagcacaactgggcactgcctactcaacagccaaggcttggccatccccactcctcagtatgggccccagaacccagggcctgggggactctgcacacaggcatgtggagaccacagaagcctgcccaatatagcgctgccaggaacagcaaagacaaaaccagagaagcctatcgcgggcaccgctgtgggcagaactatgtcccttcaatatttttatgttcaagtcctaacccctagtacttacatttgaagacagggtctttaaagaggtaattcagggttaaatgaggtcatgagggtgggccctgatccaatagactagtgagcttatgagagattaggacacagacacagacagggacacggcaagaagatggctatctgcaggccaaggagcgaggcctcaggagaaaccaaccctgcccacaccttgatctcaggcttctagctccagaatcatgaggaaatgtctgttgtttaagtcccctagcctgcggtcctttgtcaggcagccccagcagacaaacaggtatgttgccctgggatggatgcaggcccctcccatcctcccatcctcagcagcaccaaccagccccacgctgggtggctgcttgtacttctccatactgagcaccccagcccataggatgatcagctgctgccgtcctatggaactcaggtgtggctctgtggcttcctttggccacagaaatggaagtggggtgacacacattacttgtggcctgctgtggcctttcccctgcctcagtgagcatggagaaatatgtccaggtaggctgtcgtcagcacaggtctgacaggccccagccacggtggcccacaggtgcaagcaagaaataagcagtgccaactgtagccgctgcgctgttggagatctttgttactgcagcacaatctggctcatgctgactgatcctgcagggtaacagctttatttgccttgctcctttattgctggatctttgggcttttccagttctgctgttcaaaaaacagtgacacccatgaggtgggtgttagagggcccagaccccagccaaggcactgcatgggcatcattctcattcaacccttctaaccaccccatgaggaaaaactctggtcacagctcaaaaaggtcaggtaaggaccctcagctcatgcggggaggggaggaggcaaggccaacctccagtccctgctctaaacccccatgtagtggtaccgaaccatgaccacccctggcaagagccttcatgcacctagcaagtagtcacagcatgcatgtgcctagaattgttacgtggtcaaattatattattgtgtattcccaccaacagtatgagaaggtccacttctccatacctccacaactctgggcatctaaaacttttaaaatcctggaatcataggcaaaaaaaaaaaaaaaaaaaaattcacccatattttcctctagtactttcataattgtaacattgaaatctttaatctggaatatgtactggcataaagagtgaggcacatacatggctttactattttccagagggccaactgcttttactgaataatccattttactcgttaattggaaacacctctagcctgtactaaatttccatatttatttggcccgtttcaaagtcctctattctctgctcatctgtccacatctaagtgctttaactattgtggctttataaaatattccaatatcccataggaccttatccttagtacttcctattttaaagttttccttgcagacaggtactttaaataccatctcacagcacccatcatgtcctatcttcaggaaataaaatctctgggtatttccaagggaagtgaaggactgacaccatgattagaaagcagagccagcaccatggcccgtccctgagcatgtccagcaaaccctgccaggctctgcagctcctgagcaccctgccttcgggtctgccagtgtgtgggggccagaagagaaaaacaacccagggggaatgcctccttcccccagcaggaaagcagcttggtcatcatctgtctgaaagcaggtgctgcagcagctggcaacaaagccactctgaaaggagctgtgtgcactgcctgtctggaaggccatgccagagtccatcgttgcctccaccctacctgtgcaggaaacctggacatcaccacttcaaggccctaccttcctttctgggcagagcccaaccacaataaacaggacgcgttttaattaaaaaccaggtcacctggactctcccaaggactctcaagcctgcctaggtggatgctgcatgactggccctcagacacacggcagaccataactcacacacccccaggagctgcctgggtcccaagggcacaaaagccccaaagccccaataggacagggttcaaaagagaaggcagcaatcccaggctggagtatccacttcaggtccactaaagggagatggggaaggtggcctgtccagaagcctgtgggacagggtaaaggtcagctgggtgactaggctgtccatcctagagagcaactctgggttctactgccagacccacaggtgagccaggccacagtgcactggaggtaggcatcagggagcagtctgacccaacccacaaaaggggggatggggcctgagtcatcggacggagggcagctgtgacctggcacagaagcatggggctgggccaggacatccagggacttctcacatctgaccagaatcaagactgaaaatgggtttcttctgccagctcacttgctttgctaccagggctatacctgctttctaaaaatagcttcccacctatttccaaggtttccagttgttttacctacaaggtatctgtgccctgaaataactcacacataaaaccatctgaacccagagccttttctagtgatagttaccataaaataatcccaacaatttatatttttctaaataaggtttttgttttttgttgtttttttttttttgggatggagtttcactcttgttgtccaggctggagtgcaatggcgtgatctcggctcaccacaccctctgcctcctgggttcaagcaattcttctgcctcagcctcccaagtagctgagattacaggcatgcaccaccacacttggctaattttgtatttttaggagagatggatttctccatgctggtcaggctggtcttgaactcctgacctcaggtgatccacccaccttggcctcccagagtgctgggattacaggtgtgagacactgctcccggccagtttctgaataagtttaatcagatgcttgctaattagtttttcctaaaatagttggctgtatttccaattcacatttctgctttttcttcctactttccaggaaggtgttgttttgttgttttcacaattgtaaacctgaaagggacttgaacttcttgtccaagcaccagagtgggcacacactgcacacactgggcggctgtacctgcctatcctgtggtaaacttggctccaggagcttccaagctcagcttccactagaaaacccctccttgtgtggaacaggtctttcttcattccattcctctgggcctggggcctcacagctctggactgctgcctggtcctcacttcacctacagctctcggaagtcagttctctacctgcagagccacccaccccctactcagccccacccagcttctttgatcagacccttggaccctcaaagcccctgccagaaaccacagctgcaatgctgacctggaatgctcatggccaggcctctgctcctgacagaatgggaaacaaagacttgctggtaggcagccactgcaccacctcagccagtaatccaacacgtgtttaatgagcaccaattgtgtaccaggccacagagctgactaagacagagcccctgtgctgagggtcacagtctgccaggagggagatccaagtcatttacacactagggcttaagtgctgaatccgcaatgcatgcgagtgcggagtgagcaggggatggcagcacagcagcagggaagaggagcctgcttcagaacaccaggcacgattagagctacagtgttaacacacaaagggcgaatgcctgcagctgagcctggcaaggggcttgcatcccaccttcctgcatccaaaccttccagctgcccagaactgctggtaatcccacaggaaacatcattctttgccaagatgctatcccactcatcccccagaatcaaagtggccacttcctccaggcagccttcctcacattccagctgggacagaagtcacagggagcagagagggtggggctagggggacagacacagaaaccccatacaggaacgaggtcccaacagggcagacgtggcagacccagttcagtcccagccagtgtggaagacaccaaggggggtgttttatgggggtggaggtgacaaagatgatgcaactatctgctgagagttgatctacaaaacgaccccctcgtgggagcaggcctgggtgagacggcactcccagaagacgggcagggatgcagcagagagccagcagcagggaaagggcacagggcggaggtcaagctctgctggagttgggggagctggttctgctcagcgcagagtccaaaacaagcgcatcttgcccagctatggggtctgaagtcatctggggacaccactctgctctgactggggactatggggcgctcaagccacacaggccacttcatcatgaggggcagcattgttcccacctgggctgtgttcagaacccaggagaaagtggtggctctcctggggtctccggggcctccaccacctcctgtggggtacctaaggacacctcctggtctccctctgtctccaaaacctcctcctctgttttctggggttttggacctcctggatgagctgggtctggtctctgggcaggaggattagctgactccgacagtctagggacaggtgtgggggctgcctcctctggctgggaagaggctggttccacaggaccaggcttggagctacatgtagaactgggcaggactgggggctccttgggcccaggggtgctctccttggtcagctgctgctcgaacagagcacttctagatacagagttggacccagacacagcaggggtggccatggcggctggtaaagacctgggggcagtacccatgtcgagtgccaggccctctaagaacctagctaagtattgcctcaccacaggcagctgaggggccactggcagctggctggaggccaggggcaggggacaggtaaccacagcatggtactcagcaaaactgttcgggtcttgaacaacttccttgagatcctggcagaagagctcgtaatcgtcaggcaggggcaggtccccatcaaggtagggggctgcccaggcctgggctcggcctgttaggcgcctgaggatctcgcagacacggctgatgttgtcctgatagtgctcaaagtggaaggacatgtaatcgcccagctgggccaagaagcggtccagtagccacggggagccatcaaaggtgcctgggtctgagcctggtacccagcagaagtccaccctgtggggtcgggagctgggcatgtgcccagctaggggacccctttctgcaggtttaccgccacaagtgccactagctgtgctcttctgctccatggtcgttcgcacacacacggtgtccccacagcagggccgctcaatccagggatccacaaggggggtgtatgccaccccaggagacgccttgtccatctgctgccatggatgtgcgttggcataattggcggctgcccagatgggaatgcgagggccctgctgacggcaccggccacgaggcatgctgggagcacaggggagaagagaggagagccagcactggtgggtggtgggggtgtggacagatgtggcttgcacgacacaacaggacagggatggctgaacagggcgtggcagacccgcactggtccaggcaagtgctgaggatcagggagctgacagctgcagcctcaggagagctgagaagagctgagagactgtcagtcgcaggccatcatccgaggcaatctgtccaaagacaaggtggggaagagcaggaactaggcctaaccatcacccactggactggtgggaagaggctacaagcgggcaaccctctggtacccaactaggagctttgaatggaaggaggggcccagggggctggcctgggaggtctgaggtgggcaaatgctgcctatgacattgcaagggcaaggcagaatgacagatgctgtcaatttcagaagaaaaggggccagatcagaactgtcaggaatttcaggatagcaatagtagtaacctttcactgagtgccccatttgtgccacctcccccacaggaggttggtactagcattgtctttgaggcacacagtggtgaagtaacttgtctgcagccacacactaacccataagtggtggaagcagcaaaaactggctggagagaccagaggcttaactactatacagcacgcgattataaactacatttgtctgctgagtaggctctagccgccccaaaaactctgaacaacgcacagaccgcgtcgtcattaggctcttttacatcccagcaccaggcacacagcaggtcctacctgcttccccgacagagcagtgagcctgctattctctgctccctcctgaccccacatgctttccaaattcacctctcacaactgagtgccacctgcaggcaatgccacccccacccacaaacaccacctttccacagtccccatcccagccacagcagagcatcccagcccccaccattgtaaaatcctggaaccccacttgctgtctgctcccgccactccagtcacttgtgcccagggtctggggagtcccagtctgatggctggacccgcccctccttctccacgcagcagtcacctaggaggctccagagccagtagccagttctattccagtgcaaggagccctcctgtagggctcttacactctgcagcctaactctatctagccccctccccagtctctctgcaaacggaggcccactcacgacctccaggaaactctctgcttcaccccacacacaaacgccaccggctcactgggagcacaaggcctgcacacaccttcatcccacatctcctatctgctggccatcccccctcagggtgagttcctccaggtacctcccagggtggcctgcagcactagaacctgccagggccactggccctacctccaccacccaaacactctggaatccctcaggtctgacccccctctggggggggggtcttcacctgaaagcccagcccatgaccctggcttcccaccttactgcaggattatactaaggcctggacgtgagtcgagtccagtccagtccctcactgagctctaaaaaagcagtgaccccgatccagggcccagctcccaccaccagccaaggttaggtatccaggttgcccacaatgaccacaccccatgcccgggagccacagtgtgctacccagatctctgccttcccttcttcccagtcccctaccctgcccactcacctgcgcacctgtgtcccctgcagtctgggagaaggcttccctgcaccagccagccaggcctgctttgggcctgagccttcctaaccctgggccgcactctcaccattttgagaaccttagccctcccacgcctatcagtctgttggtccccctacttttctccccacactgcctggcatagaagactttcggcccttctagactggacagcactatcctaaaggggcaggtaccacggcgcatgtgtgtttgcccccacaaggccaaaggcagcacctggaacgctggagccgttctctgctctggggagacccaggagccccaagaacaaaacctgcccaaagccttaaagcaagctgagtgcagacgactgcaccgcccgccccccagcaaccgccatgcaggaaatacgagctcacaaggcccacggcaacaagaagcccacccacctgaggctacgcgaatcgcccgcgaagagggtcctgggatccgtagccacagaccgtgggacgggcctccctctgagggcgagagtccaggcgccacctagaaagtggagaacgagatcggccgccgtgaggccaggcaaggagcgggcgcggcttcccgagactgcgagaacggcccaaatgtctccaggtgcccccacaaacccccggcgcggaccgagaaactgaggcccgcagaccgaaggcactgcgacccaggctggggctccgagtgcccctctgcggatcagaagtcgggaaaagacgcaggggcgcagctccaggcccgcgtgcacggagttcaagccggccgcccgggctcccgcctccacactgaccctcttgccggagtcgggaacgcctgctcctaggagcgccgcgcagcgtccagagaccgattacatcgcgcagccacgcccccagcgtgcgcgcggccgccgtgtacgacccggcgcatgctcccggcacgctccacgcgctcctcccatccaggccgcgcctgcgctgtatgccgtgtggccgctacctcgcaggctctcccggtccctgctggcgcggcagtgccgcgcggtgggtgatgggagagcgcgcccattcccacgccgcgccaagtgccacgggatcaggtggggccgcgtgtacaggcgcgagacggtcgggccaaagctgcccctcatgatccccagcggacggtgcccggcggtccctcagatccgggaaatctgcacccggctgtggcgtagaccgaggggccgatgctgcttcagcccgccgttactgccctggcgtcagccagacactggggtgctgctgggcgtcgagagggctgctgcggggccgggctaagcctggggggctgcaggtgtcggggtggatgtgggcatagcggggctgctgggcctcgtgagcgccctggaacggcgtgcccgcggagtgcctctcatcactcattgccagtgcggggaaccttgttagggcccggttcgacgtagctgcaggctgggcgccagaggcagggggcaggcagtccgagaggaccctctacctgcatacctgggggctgcaggcagggcctctgggcctccttgttgtggatataattgtgtgcttcccgactcaggccgaggctggacccggagacgacagcgagggcaggctaccaagccctccccacagggccgtgcccagcccaagcctgccgagtcagcacccagatcctgggacaagataggtgaggatgaagtggtggtgctcttctcacttgcacaagccgtcccacgccacctctcctcggcttcacggtgcctagagaagaggtgggagagggtgcaggcgccccagctcaggatctgatgcctgtgggccaaggacctggatgcaagccaggagtccttggggccacgggcaggcagccggattcaccggaaagtgacgcttctcaaggggaacacacacgtaacacaccagctccctttctgccctggtccagtgactcctttcatgaaagctctctgaaatgttatctgcatttacacccaaactcactcactttgatccctgaaacgcgaatcaaaggtcacattgtaccttccctgggtctgtggggctttcagcagcctgggccaaaaataataaaagtggcaccgagccaggaaacgcctccttgaagtgggaatgaaatttggatttttttcggttgtatctttcctaattgacctgataatttaaacttcctccctcaagggaaaggtgggggttcccacaaattcagcttacctcagcctcaaggcagctcagtctacagctcagcgcccatcagcagagtgggcagtgggcctgtggaagaaatgaatccaactgagccagaaaaggccttttttggtccaaattttttttttctttcaggccctctcctgtgtataactgtcatgcaccgcataacaacgttttggtcaactagggaccacatatgtaactggtcatccagtaagctatagttattttattattgaagaaagaaaatttttaggccaggcgctgtggaggctcatgcttgtaatcccagcattttgggagcccaaggcgggcagctcatttgaggtcaggagtttgagaccagcctggtcaacatggtgaaaccctgtctctaccaaaaatacaaaaaattagccgggcgtggtggtatgtgcctgtaatcccagctacttgggaggctgaggcaggagaatcgcttgaacccaggaggcggaggttgcagtgagctgagattgtgctactgcactccagcctgggcaatagagtgagactccatctcaaaaaaaaaggaaaatgtttaatataagtgtgttgcagcctaagtgtacagtgtttataaagtctaaagtagtgtacaataatgtcttaggccttcacattcactcaccactcacacccacagcaacttccagtcctgcacctctgttcatggcaagtgccctaaccagttctattttttattttttgcactgtacttttactgtacctttgctatgattaggtgcactaataccactgtgtcacaattgcctacattgttcagtagagtcactgtgcaagtttgtagcccaggagcaacaggccttaccatacagcctaggtgtgtagtaggctctaccatcttagtttgtgtaagttactctatgaggatccctccatgacaaaatcgcctagtgacacatttctcagagtgtatccccacagttaagtgacatatgactgtttttttattgtggtaaaatatagtaacatttaccattttagccatttttaggtatacagttcaggagcattaagtacattcatgctgttgtatatccagtgatcactatttatttctagaactttttcttcactccagaacattaactcctcttcccctcccactcgcaacccctggtaaccatcattctatattctgtctctgtgaatttaattactctaggtacctcatataagtggaatcatacagtatttatcattttgtgactggattatttcactcaacatgttttcaaggttcatccacatcgtagcatgtgtcagaacttccttcatttttaaggctgtgtaatattcctttgtacacattgaccagattttgtttattcatttgttgattgacacttgggttgttttcaccttttggctattgtgaataatgctgctatgaacattagtgtacaagtatatgtttgagtccctgctttcagtacataagagtgaaattgctgaatgatacggtaatattttgtttgactttttgagagattgccaaacttttccatagcaagtgaaccattttacattcccaccaacagtgcacaggagttccaacttctccacatcctcaccaacacttggttaccttctcttttgtttttttccaatagccatcctaacggtatgaagtggtgtcccattgtgattttaatttgcatttctctaatgactagtgagattgagcatcttttcctgttattggccatttgtatatcttcactggagaaatggctattcaagtcctatgcccatttttcactggatttttgtttttattgttgagttgtaagatttttctagatattctggatattaatcccttgtcagatatatcatttgcaagtatttctccataggctgccttttcactctgttgatagtgtcttttgatacacagaagtttttcattttcattaaaatgtcattaacttaatttcactaaattaatttcattaatttccaagtctaatttgtctatatgttggtggtagtggtggtgttatatctaaatcattgccaaatccagtgctatgaagttttgccctatgttttctgctaagttttataggtttaggtctttatatttaggactttgacccattttgagttcatttttacatacggtgttaggtagggatccagcttcattcttttgcatttgaatatccagatgtcccagcatgatttgttgaagactatcctttccctatcttagtacccttgttgaaaatcatttgaccatatatgcaagggtttatttccaggctctctagtctgttccattggtctgtatgtctgtctttcttttttcaggaaagtacagtgttcaaactacacagtcttgattactgtggctttgttttaaattttgaaatcaggaagtgagaagcctctaagtttgttctttttcaagatggttttggctattaggagttcctacagattccatatgaattttaggatgggttttatcttcctttcttttttattttttttatttttttttttgagacagaatcttgctctgtcgcctaggctggagtgcagtggtgcaatctcggctcactgcaacctctgcctcccaggttcacgccattctcctgcctcagcctcctgagtagctgggactacaggcacccgccaccacgcctggctaattttttttatttttagtagagacagggtttcaccgtgttagccaggatggtcttgatctcttgacctcgtgatccacccatctcggcctcccaaagtgctgggattacaggcgtgagccaccgtgcccggcctttttttttttttttttaaactagacacagggtctcccctgtcacccagactagagtttagtagcctgataatagctcactgctgcctcaaattcttgggctcaagtgatcctcctgcctcaacctctaaagtacctatgactacagacatgtgctaccacacctggctttttgttgttgttgttgttaaagctagggtctcgttatattgcccaggctggtcttgaactcctaggcttggcaaaatattgggattacaggcatgaacaaccgaacctggcctgtgataggtttttatatttctaaaaaaacactgttgggatgttaataggattgcattgcctctgatgaccactttgggtagtactgacatgtgaacaatattaaactttccaacacaggatgtctttccatttaattgtgtctttaaatggatataattgaacacaggatgtctttccatttaattatgtcttctttaatttctttcaacaatattttgtagttttctgtgtacaagtctttcacctccttggttaattcctatgtattttattctttttgatgctatttaaatgaaactgctaatttccttcatgaagtgttcactgctagtactatatagaaatgcaactgatttctgtgtgttgattttgtatttgacaactttgctgaatttgttaattattctgtttttatagaatcgctataagatcatgtcattggtgaaaaaatataattttactccctatccaatgtggatgccttttattttcttgtctaattgctctggctaggactttcagtactatcttgaatagaagtggcaaaagcgggtatctttgccctgttgctgatctttggggaaaagctttcagtcgttcaccattgagtgtgatgttggctgtgggtttttcatgtatgggctttatcatattgaggaagtgtctttctgttcctcgtttatttagtatttttatcatgaaaaggtgttgaattttgtcaagtgctttttctgtatcaattgagatgatcatgtgttttttccccttctttctaatgtggtgtattacattgatttcaatgtatacattttttcttttttctttttttattgagatagggtctcgctccatcactcagcctggacacagctcgctgcagcctcaattcctgggctcaagtgatcctaccccctcggcctcccgagcagctgggacaacaggtgtgtgccaccacattggcacttttttctttttctgtagagacagggtctccctatgttgcccaggctggtcccaaacccctgggctcaagcaatcctcccaccttggcctcccaaagtactgggattataggtgtgagccaccacacccggcttcaatgtatatatttttaaatgattttaggccatgtgtggtggcttatgcatgtaatcccagcactttgggaggctagggtgggaggattgattgaacccaggaattcgagactagactggacaacatagggagagcccatctctaaaacaaaacaaattttaaaattagctgggcatggtgttgtgcacctgtggccccagctactcaggacgctgaggcagaaggattgcttgagtccgggaggtttggggcttcagtgagctatgattgtgccactgcactccagcctgtgcaagagtgagaccctgtctcaaattaaaaaaaaaaaaatgtggaactgaatcctttcgtatccatcagaggccccagtttcattcccagaaaggagtctccttcctgccctgctggtggggctgcaccctacttgactcctttggatacttcagacaccctaccatcttagccagggcagggaggtggctgggcacccaagcctggtgaccctggggctgtttgcgcttcaccccttagaaaccagtgttctctttgtgggtttccttccattctttagttttgttttaattaaaaaacaatttttttaaaggcagggtctctgttgcccaggctgagtacagtggcacgatcatagctcactgcagccccaaactcctgggctcaagtgattctcctgcctcagcctcctgagtagtggggaccacaggtgtgtaccaccatgtctggctaactttttaaatttttgtagaggtggaactcactccattcttttttattttttttaattgaggtaagacttaagtctcaggtacgaacaacaacaaaattgaggtaagatttactacaatggaaggcacggatcttttatatttttaaaaaatgttatcaggcagcctcccaaaccagaataggtttggagagactcccagaatgcacagatcttaacagcagggtttcatgacttttgtatgtgcagaccactgccacatacgagtaagctacggaacactcctttccctgaaagcacccacaggcccgttcctcacaggcaccgttctgatttctactccatccctttattttgctcactctggaacttctcacaaatggaatgctacagtatagactcttgagtctggccttttccagtcaatacagcatttgcaagattcatcaatgttgcggtcacatgtgtctcatttgtttttttgtttttgtttttcttaagcacagtgtgatagtaaatctcatttgttctgagtgctgtgtagcatctcattgcatgactacagtttgtctgtccattctctctgtctctttaattttttgtagagatggggtcttgcttgttgccaaggccagtctcgaactcctggtctcaagtgatttgcgcgcctcggcctcccaaagtgctgggactacaagtgtgatccactgtgccaggcccctgttctcttattgatggacattcttgtgatttctggtttggaaccattatgaataaagctgctctcagcattcttgaacaagttctttttgttcacctaaggtttcattacttctgggtaaatatctaagagtggacttgctggatcatagggtaggtgcatatatttaactttatttatttgtttattttattttgagacagagtctgtagcccaagctgaagtgcagtggcacaatctcagcccactgcaacctctgccttctgggttcaagcaattctcctgccccagcctcttgagtagctgggattacaggcatctgccaccatgaccggctactttttgtatttttagtagagctgggggtttcaccatgttggccaggctggtctcgaactcctgacctcaggtgatccacccaccttggcctccctaagtgctgggattacaggcatgaaccaccacgcctggccaatacatttaactcaactttatatgaaactgccctctaggcgcagtggctcatgcctgtaatcccagcactttgggaggccaaggccgggcagttcacgaggtcaagagatcgagaccatcctggcgaacatggtgaaaccctgtctctatttaaaaatataaaaattagctgggcatcgtggcacacgcctgtagtcccagctactcgggaggctgaggcaggagaatcgcttgaacccgggaggtggaggttgcagtgagccgagatcgcaccactgcactccaacctgggtgagagagtgaaactccatctcaaaaaaaaaaaaaagaagaaactgccaagagcgtttcacagtagctgaaactcatctttcctgcagcattgtatgtgcattccagttgtcagttgttccacatcctcaccacacttgctattgtcaatcttttacattttaatcattctggcgggaatggagtggtatctcattgtagttttgatttgcattttcctggtaactaatgatgtccatgattttatgtggttgtttttcaccttctattaatttgcaagagccttggggggtgttttgttttgttttgttttgttttgttttgtttgttgtgtctcgctgtgtctcccaggctggagtgcaggggcgcaatctccagtcactgcaacctccgcctcccaggttcaggtgattctcctgcctcagtctcctgagtagcttggattacaagtgtgcgccaccacacccggctaattttttagtaaagacggggtttcaccatgttggccaggttgctctcgaactcctgacttcaagtgatccacccatctcagcctccccaaagtgctgggattacaggtgtaggccactgtgcccggccaagagtttttgcatatattctgaataaaagtctttgtcagatataaatattgcaaacactctttcctaatctgtcacttgcctactcgctttcttgatgtgcccttttgaagagcaaaacttttacatttggatgcctgtgctttttgtgccctaagaagctttgctacctgaacgttatgaaggttttcttctgtttagttttggaagttctattattttcacttctacatgcaggtctgtggtgtattttgcattgattttcatgtgtgatgtgagtcaaagtttgttttctccttatggacatcccattgttttagcaccattaattaaaaggactgtcgtcttctccattgaatcaccttggcactcttgttaaaatccaggtactacatttgtgcggatctacttccggacccctattgtgttccactgatttttgtcctcaggcccaaagcataccgtattcattattgtagctggccaggcacaatgctcacgactgtaatctttgggaggccaaggtgggagaatcacttaaggccaggaatttgagaccatcctgggcaacatagcaagactctgtctctataaacaaaatgatagctttatagtaacacttgaaattagatagtgtaagtcctccaactctgttttcctttttcaaaattgttttggccattctagttcttctgcacatacatgtaaactttgtaatcaatctgtgaatttctataaaaataatcagcctgacaattgctcatgggattttgattaagattttgttgaatctataaatttggggacatagaacatcttaaaaatatctcatctttcaatccttgaacagattacatctcttcattgatttaggtcttcattaatttcttttcttttttctttttttttttttttgagacagggtctcactctgttgcccaggccggagtgcagtagcacaatctcggcttactgcaacctccacttcacaggctcaaacgatcctcctgcctcagcctcccaagtagctgggactacaggcatgtgtcaccatgcctggctaatttttgtatttttaatagagatgggtcttaccatgttgtccaggctggtcttgaactcctggactcaagtgatctgcttgtctcggcctcccgaagtgctgggattacaggcatgagccaccgtgcccgaccttaggtcttcattaatttctttcaggaatgtttatagttggcagtgcataggtttgggcatgttttattaaatttatccctacacattttatgttttttgatgctactgtaaatggtacttttaaccaccacatgtcctcactcatatgtggaaggtaaaaaaaatgatctcacattagtcaaaagtaaaacagaggctattagagctgggggaagggagggagagagagagacgtgttgaaggatacaaaattccagctagatgggaggaatacattctagtgttctacaccactgtaggatgactgcagttaacaaaaatgtatagtttcaaatagctaggaggaggatagcaaatgttccctaacgcaaagaaatgataagcgctagagatgatggataagctagttgaccggcatctaatcaccacacattgtatgtattgaaacatcactatgtaccccatgggtatgtgtcattatttgtccatttaaattgttttaaatttcactttctggttgttcatagctaatatataaaagtagatttgacattttcccttgagttcctgctaaattcacgtattaggtctagtagttgtcttatagattccttaggagtttccatgtccatgatcgtgtcatctacaattaaaaacaattgcgcttttctttcatatatatatgttcatttgtatatgacatttgcatattgatttacctataatgtacatatgatgtgtacacatatgcatacatatctatacaggatttttttgcctatgtcagtggccaggtccgtcagtgacaatgttcagtgaaagtggtgtgagtgggcgtccttgacgtgttcctgattttaagaaagcgtttggtctttcacaattaagtacagcgtaagctgtagatgtttctcctaaatgcctttttatcaggttgagtgagtttccttttcattttagttcctagagagttttattttttcgtaaatgggtgttgaattcggtcaaatgctctttctctgttgatatgatcacggtattattctttgtcattctgttaatgtgataaattacgttgattaaatgttggctgtgaaattgtcttgcattcctgggataaattccatgtggtcataatgaatgctttgtacgtgttgctaagtacaatttgttcacattttgttaaggacttttgcgtctgtattcttgagggatgatgctggcctcataaaatgagtttggaggtgcttctcccttctctattttcctaaataattggtgtaatattggcattatctcttccttaaatgtttgatcaaattaaccaatgaaaccatctgggcctggagttttctttatgggatagaatttaattattttaatagatatagagctactcatattttctgctgcttcttgtgtaaattaaggaatctgtctagttcatctaaattttcaaatttagtgaactaaatttgttcatattgatttattctccttttaatgccagtagtctctgtagcagtatttcctctttcatctttgatataggtaattttatggctttttattttcaaataaccaacattttaccttactggttttctccattatttgtttcctattttattgatttccacttttatgtttatttccatccttctatttactttggttttaatttgaacttctttttctgttttttgtgttttgtgtttttttttttttttttttttgagacagagtctcactctgtcgccccggctggagtgcagtggcgcattctcggctcactgcaagctctgcctccggggttcatgccattctcctgcctcagcctcccaagtagctgggactacaggcaccaccaccacgcccagctaattttttctgtatttttagtagagatggggtttcaccgtgttagtcaggatggtctcgatctcctgaccttgtgatctgcctgcctcggcctcccaaagtcctggaattataggcatgagccactgcgcccggccctttttctggtttcttaaggaggttgcttagggcatagattgtaaacctttcttcttttttaacataagtatttaaagctataaatttccctccaaccactgccttagctacgttctagaaatattgatgtgttattttttcattgtcatttaattcaaaatattttccaatttctcttatgagttcgtctttgattcttaagttatttagaatgtgttgtataatttcccagttgggagcattgccaagctatctttttatgattgatatttattattgttgttatgtcctagtgtatggtctacttggtgaaagttccatgtgcaactgaaaagaatatgaagtgtgaaacgtatgtgaagaatgatggtgggactctggtataatcatcttggaaaaagtatttgtcattcttgtgttaaacatatacctacctatgacctagccatttcactcgtagatgttcatccaagagaactgaaaatgtatgtctacacagaaagttttacattaacattcattgtagcttcatttgtaatagccaaaaacaacccaccagtaggtgagtggataaacaaaattggcgtatctatacaatggaccaccacttaccaaaaaaaacaaaaaagaaaaaaaaaacagctcctgatactggctttttagatgtacctctttgtattttagtggttgctctagaagtttacattgtacatctttattataacctacttactgtatatctttattataacctacttactacctacaccttatatgtactacttcccattaagtgtaagaaccttgcatctgtataattaattccattggcaaccatgtttttgctattgctgtcatatgtttttcattaatataaacccaaatatacattgttataattcttaagtaatcagtattgtttaaagaaaataagagaaggaaaaatacggtatttttctttacctgtatattcccacttcctgtacccttcatttcggtctgtccatctaagtttccatctgggaaaatttcccttctgcctgcagaactttttactgcagtttttgtagtgcaggtctgctggtaaggagtgatcttggctgactttatctgaaatgcctttatgtctgtttagggtttgaaaagtagttcactgcacatagatcttggagttgccttcttttttttttttttttttttttttaagacggggtttcaccatgttggccaggctggtctcaaactcctgacctcaagcgatccgcccacctcggcctcccagagggctgggattacaggtgtgagccactgtgcctggcccggagttggctttttcttctttctgcccatacacttttttctgatgggaagttgccaggcgtgtacaacatgtcccggctgctttcaaggttttctcttaatcttggggtgtccaagagtttgactgtgataggcctggctgtgtttctttatccttatattgcttggagtttgctgtgattctttgatgtttgtcaacaaattcatgaaactttaggtcattgtttcttcagtttttttttcctgcctcattctctctcctctcctgagacatcaggatgtgagttgttttaatattgtcgctcaggtccctaaggctgttttttcattgttctttttaatcttgttactctctatacttttgattggagaactttttaaaaatctctcttcaagttcattgacccttacttctgccatctccaatctcttcttaagaatacagtccatccagttaaatgtccaattttcacttgttatttttacctttactttttgtcctagaattttcctttcttttttctttgagatggggtctccctgtgttgcccaggctggaggtcatgcatgcagtggtgtgatcatagctcactgcagcctcgaactcctgggttcaagtgttcctcccacctcagcctcctgagtagctttcaagagtgagccactgcgccctgtcaaccatggacacttaaaaacagaaaacatagcataaagccttcatgccatgctttacagccatgctttgagcacctactatgtggcaggtaccatgctggggacaaaaatgtgaagaagggaggcccctgcagggcaagagagaaagacaggctttagagtaatcaagaaacagcattctgtgggagccctaagcgggtgcctcatcttgccagctgacagggaggactcctggaggggagcctgtgtgttgaatcttaaccaatgagggggcattagccagggcagaaagaggaaggcacagctttgggctgagggaacagcatgggcaaaggcacagaggccagacaaggcgggtgcagaagaaagtcccaggcaggagtaaaggcagtgtccccacccactgggggcccccaccgtggtggctgtctggtcctcacggcggccctccgcgggtggggtgggatcagagcttgtctgagctggtgaaggcgggactcatccctgctgtgtctgggcctcctggtgcggtcttccgccctgacatgcctgggcacctgggagctgacaggtacagcacctttccagagatgtaaggcactggatgggagactctgatctgtaaagaactggctgatgggaagcgcctgctgcattgatatggcatctccgccccaccgaggctttgaaaatcaaatactccccaagctatggaaacccaaccacaggcggactgttaggactttattattataatcactcggcccaattccagccaccgcgggcagaacaatgagccattgaatccttgcagaggtctcgcctctcccatgggcagggacccggtgctgaggccttggcagggagggtggtggcaggcctgtgcgctactgcacagcccgggggcccgtggggggtctgggcttcggtctcctcactcatcgagcaggaggcctgaagagaacacatccggatggtgctgcactctcctgacattctgtcccacattgtgacccttgtaggtcaggaactaactctgcttcagggagaccatgatgcagaagacaccagcgtccttcgcagtcctcagcatgcatggcctcgcctatataatcacaaaaagggagcctgtggggtgttcccgccccaagctggggtgcctagtataggggtggccctgggagtcccagctgggtcagaggccagcagccagggtagagggctgggcacagttggctgcacccccagctgctgagttacaaggccacaccacctcctgccggtggctccactttattctcaagcatttggtgttatttgatcaccagttataagccaaaaagattccagttttaattaggggggaaaagttccattctgtggaaccgcaaggccccatgattgtcccacgaaaccctagaggccaggacctcgccaggcttgagccaggtctgccctgcccttcggtcctgcttcaccggcaccgctggctttgcatctccatgtcctgaacacacttgggtttgttgggcctggattttcactcctgtgggtgcccagccctctgccctgcccctgtgagagtcagctaccaaccaaaaggcacagcgggggaagttctcttctgtctccaaagagtctctgcttgtccccctcactgggaagtaagggaaggctctgggaacgccagcttgggttttgggattagggtaacctgagcaccgtacaccatgtcagggctgggatcaggcaggctcgggcctaagatgctttgctgggccccacagacggccccctcgctgtcctcataggcacacaggattggctgggggccaggacaagcagggctccagaaccctctggcggcaggaccagaggtcagggagatttgagggagttaggccacgcctcgagagcaggcataggggaagatgagggacagaagggtggtcagggtgcggcaggagtgaggctcggctgcatctgcaggacagcaccaagggcccacgggcaccaggcccaggtctgaagctgcagccctgacggttcccatgatcaagtgtgcagggattaaggagcagtatctggaaaatgggcccacagtcttgcctctctctcccagggttgcccagaagacccatccagggtgttgacagcagcaatcactggcatttagtgcatggacttggccgcagggcgtaggcaccgtgtgggttgtcgtcctccactcctggccagtgcaggcagtctcggctgctgtcgcctgtattccctgacgacccgtagtgccagcccgagctggatgctgtcaccgcctgacggagcgcagggtgtctgtggcaagtcctcaactcttggccaaacttcaccctgcatggtggattctgggaacagaaatcgatgatgccagccacgcctgccgggcttggaggtgggccctgtggctgacgctcagggggctgctgcaggtgaggcccaaggagcgcccaggtgtccggggtcccatccctcccacactctgcctcccagaaccccgtcggggctgcatcacatccatttcctgggttatcagtctcgtggcagctcttgcctgttgaagaatcttctgtccagctatttcccaagctgaacattccaggttgtggctggacaggcccttgcccgcctgcccccaaccctgagctccttccttcactagcccaccagcagctcggctccctgcagccggccccgtgggacctggtctgggcaggggcacagcagagctgggatctgcacagcactggagcactggatcctgcctggaagagcacagcccagaagccccaagcacaggggggaggcccctcagcccgggcgcagagggacatgggagcacacggagccagttcctccctgcctgccttctgctcggggtggcagccaggacgccagcgtgtacctctttatgcccctgcctggtccaggaagaacctcaggcagcttgcagggccatgcagtgcccagccagagagcccagctcgaagatggtggtagaggaaggagaccaggctgggcataggatgctcccgtgccaggctctgttgagctctgggcttccgctgggagggctggggaggggagggccagggagacagaggtgggctagcccaaggacgcagcctgggggcccatgggaggggtcttgtgggccagtggccctaccaggacgggcgtggggctgctgcctagggctccatggaagcccagggagtgggatctggaagtctctctcagcagctggctggctctctggcctggccaagcaggcaaaagtaggggccaaggtgctgggtggatgggctgcggggtccctggtggcatgggggcccacgtccaggccctgctagagcagtcccaggtggggggtagctgggttgtggagagggacaccaccccagcacactcccattctagtcttcgccccatgtgagttgggctgaggcccccacatgggctgggaggtccacagcctgtgcatttggggccaggagagggcatcttcctctactgcccaagagtaagacctggcccaggcccatctggatggagaggcagttcagagggagatgcttcctgatggggcgccctgtgcctgggccttaatacctgtaggggctgcaccacctgccctggccactgatgctggcccgctggccttgggtgtagaccccctgctgcttcctgctccagagggtggggatccccgtgtctggcaatgaatgacccacaccaaccctcctggaccctgactaggcccaagggtgggaagtggcgatgagtgagggcaggtgggcagaggccagcaggtctcatcaggctgggcgggaggatctcttgcccaggacaggggcactcagggaccctggggaggagaagtggctcccagagggacacggggtggggcagcagcctgggaccgagaccaggaggctcaggtggctctgagctctgggaggcaggagtggcccccacccaccagcccaacgcagacaccaacacgcttctcatgccacccactgaagccaggtgccaacctgtgctctcttggggagggatgtgagcatggggcggtgacgccactaggatggagcctcaacccgaggtggcccaggcacctggagcctcaatagggcctggaggggttagtgtggcctcatggccctgccccgatgagcacactgcccagccacctcagggcatccctcattaaaggtcttgggtcacctccagttcttgcccagtgtgtgaggggtaggtgggggcctcaggcctgcctctgggtcctgcttcaacctggggaggggaccagggcccagtgcccaggcactggcggcacctccaagctgctgcactggggctggagtggccgtgggccaggtaaggcaagcaggtgtcagccgaggtgagctcatgtgccaagaccctgtgggaggagcccaaacccgaggccaggaaacaggtgctctcaactgcagccccaccaaactgcagccccacctgacgctgctgctctcacaggggcagccctgcctgagggcctagccagcactaaggtcacctcacggccaggagagcagggccgaggtgcccgatggctgccaagtgaggctagggccaagcaagggtgcagcatgctcagggagggggctgcagtctgagcatctcagttacccctccccttgagctgatgacccctgctgtaccccctgtccactcctcagagccctgccaggccctgccctcccctgctgccccgctgtggccctcgaagccctccataactgtgtgtcccctcccctgcatgtggaccacccagggggcctggggaactgcccaatgtcactcaggggtgttgggggcaggagagggtgacactgccccatgcagggtgtggcagagaggggccactcagcctcgctgggcagcaccccccgcccacttctcctgctcccacgtctttgcgagatccggtgccacagcagaagtgtggaggatgtcgccgggggtaattgcaggttacacagaacaatctgaggaattaaagtcatatttttattgcaccataaaaacatgtgaaggcggcaggacggcggccgcggggccaggcggagagcacccggctctggccccaccctgcactccctgggccgtctccagggagacgcaggatcgaaaccactgttggcccagcacaccggtcccacgctgggcaagggagaccgggagagcggccgctttgcccacattgccctgctgggccctggttcctgccctggctgtgcagctgcctgggtgggggctctgggccagtgtcccaccagagtagtgaggtgtggggatggcctgtgcctgcggggtcccctgggcctggtctgcagccaggtgcctgccagttcagcaccggccctgagagggcctggggcagcagtgctggcctctttgtggccactcttcacctgcagcacccattgcttgtaaactgggctggacccctgcctaccacttaccaggagggtatgagcccctgtgcagcaggagcccaaggacccacggctgcctgggatgtgtgtggtggatgttttggtccctcctaggggatgtgcaggccggctgaatgggccacacagcgtgggagagccgaggtcacagagagcaggtgtgtggtacacggtgtgttctgggaagaaggggcacgcagagaaaaccacctggaggggccagtggggacatggacgtgtgggtggctctcaggccaccagcaacaggtactcctggtcggctgggcagacagggaggcaagaggccctcccggcagaatgcggcccagtgtgtagtgcgggctccacacagctgcatcctctccatcaccacaaaagcaccaaggccatttcaagctttccccatgctccctggcaggggctgatcccagggccaaggaatccacaggccctctgcccccttcctggctgctgcccagagccaccccccagagcccaggcagcaggtgtaggctgacctcccagcctggcggtgcctccacggcaaaaaaaacttgcaggcctagaggcgagccccacccacaggatccggcccaggcatgccaccagccgtgtgttaaatgggacacggctgatctagagctgcacttgtgggagggcctggcccagcacttggcatcttaagtgggcgtctgagagctcacgcgcacgtttcacacagcaagtcgggctcctgcaggcccattaaggtgcaaaggcattcctctgtgtgctgacaagcagggtcccatccacggctccgggccggcagactaagtgatgttttcttaaggaagacacgcgattagccacagctaaagccccagcacaatgcagggcccggccatggctgtcagcgctgtctctcggcagtgactgacaggcactccccagcccatcaagcctcaatgcacaggattagcctgacgcagccgacaagctgacttggagggccacggtggaaaaccggcaaagtgactgacatccggggacagagagcctcacacagccctgctacctcctgtcatgggcctgcctgctggcgggctgttccagaacaaagccggtgttgccgcccctcccaagagcctccctggcactgggctgcccttcttgcttcaaggtgcagagacctaggcagagggtcccaggaaaaaccctcagtgggcgtcttcaggccagaggccaggcagctgtggggcaggtggggcggctccgcctcctgcctaagtggggtccctagcactgcaagtctgctcccctctgcccagggctgcttggaattgtgctcgggggttcaaggggccccagcggactctgggctgccctggatggaagctactcacgattgaagaggggcctggtggcctggccagaccccacccacctgggcgatcctgggggaccatcagggacaccgcaggcagagcacacttcagaaaaagtaccctctttatttgcattgcagaaatgccagggggctcggacatgggtgcccacagggtaggtttccacccaggtcgtcatcatctggcaccaggagcctgggggggggtgcccggcggcagaggctgagaggtgcaggggtgaggtggacagtcccctgagccatccctgtggggcacacgggccacctgtccagcacttgcgctccacgctgaccatctcacaggcgctccaggagagggttgaggccccccaaacctggcctgcagccatcctgccaacaacaggaaggtcagcacaggtcagccacccacccctcacatcagcctagctatgtctcccactgccacacccagggacccccaagggagatgggtgagaaataaacccagcagagaatggccccaccccagggcgatgcgtcacagggagcgacgcggtgctacaaaaatattttgaaatgataaaaatttatagcaggctcctaacaaaacagctctgggaggtgtaatgttctgataagagtttcctcaggatgccctttgtttatccctatcgagcgcggccccgccggggggaggcggccacggtgaagcagggggccctgagtacccccagagaggcctccccagagcccctcggcgccatgcagaccctagagcctgtccacaggcatcttggggggagcccactgctctgcctggtctccacctcagccccgggggagagatggagcccaaacaccccaaccctgggaggggctgacagccatgggggtgccccaggtgggctggatggcacgggctgagggcccaccctgccccggcccctgccctgcagcccaggccggaggatgcactattagaccacgaggcgagggggctctggcacaggcatccctggggcagaggccaggagcccttgccagtttcttcctccccagaagaggtcacgatgaacaacatgccccccggtcagcctggctctgcagagctggaacagaaccagatgtgcagggcaggctgggcagggccggccatcacagggcagcgtctccaccttctgggagatagggaaatgagcgggcgctgaactctgcaggagccaggccttggtgggaggcctcggtgggaggccagcttcccgactgcagccccctgtggggcagcaacttgagatgcccgactttagcccacccgggacaccttccacgccaacatccacctgggataggctgctaaggatgagccccgtttcttgatacctcctgtgtgtggggagcagctgtggccaggccggggtctggggtcccccggggaggtttgggcccctgggaacttccccttctgcctgtcaccgctgtggcctggttacaggatggagcacccattctgggtggcgtggcaggtgtagccttgctgtacacctggagggagcccatggccagggctcctgcacccctgccacatgccctgtcctcaaacagagccagccccacctgcatacctgggtctggcctccgaggagctggcggcgggcgcaccgtgtgccctggcctgcagggatggcgcttaccctcagcagcctgtcaccgtggggtccaggcctgagcgcttggagatgcgcagcttgactacctcctcagagcatgtgggatggatacccacggtccgcatcacctgcgcataggaagccccacacctgcacatgggggatgggggaggcaggcggggtcagcacagggaggggggtccacagcatcccacccccgggaagaggagggcctcagaggctgctggtctcctcactgtcccctgacccccagccagcagccaggacccctgcccacacccgtgggtgccatccacctccctcccagcagatgcctagtgctcgtccagcccacctcccacccagccacgccctggcttgccctggcctggcttcctgctgttccatcctcccctgctaggcacagtcctgccttaggcctctgctctctgctttacccacagacagcgcatcctggcctcaccacaccaccacctcccaggccccacatccagccagccacctctctcaggccatgcacaatgtcccaacctccaactacccctgtcaacccacccagagcctttgccatggcttcctttgaccccgggaccccgaaaacacacagcctgagcccaagacccaggcaatggccccagctccagaagacacacagcagccctggggtggctctccaggtactggcactctgctcatggtggcgtggtgcttggccaggtgggcaagggccctagcagcgacccggggccacaggggacacctcacctggctctggctggctcaacagcgtctggctggggcagaaccgcctcttgtccccctaaaacccgccctgtctgaggggcctgaggaatctctgctgcaaacccacgaaggccacataaatgccgcaagagtggcagcagctctccactgtaggactgccggcactcgagggatacccagctgcacatcgcatcgcagcctgcattcctcgggacttacttgatccccagagcaaatccttgagtaacttcgcctgcgttggggccaaggaaatgcaggcccagcaccagctgtgggggctccctcaggcacaccatctgaaagccgcacatctcagccaccagcccaggagggggctgggttgcgtccaccctgcatccaccctgcaccctgcctgggaggcatgggtggggccagtcctcgggtgttcaccctgccaggctctttgccaccctccctctcatcctcagcaccctgggccacagggatgctcacctttacataacactgggatgcatctcgtccagccaccgtgaactccagtggtttataatgggcgtgatagacctgaggacaggataccaaccctggatcagtgctgcgacaaacaaacctcgtggcacctgcagctcccacaggctgcatgggcaaggcagggtcatggcgggcaggaaccatccatctggcctgaaggtctggtctgggatggggatgagggcttggctggccacggggtgtgtgcaggccctctcacgtgcaggcagccagtggctggagccatgctctgcaggacagaccctgtcccacccaggcctgggacccccgtaaaccacagcagcagagcaggcatcaggcaatccaagcagccaggccaggcacagcaaacctgggtggacgtagctcacccacaacaaatggtggaggcaagaatgggtgagcaggaggccacctgggctccctcaggcaccctggtgtttgcttggccctcactggagcaaggccgctgtggccacaccggagccggagctgttggacaaaggctttcagcacccctgaagggctcgacagcgtgtccggggctgcggccaagtaaaaaatgagtggggccctcacatgtgctgtacagccattattaattaatggaacttcagagaatattgttctaactaagacagaattgaaaagaaaacaaacagagtatttggccattcaacattgtgaaacataaaacaacattataaaatgccaggaacatatgtcccagcacacttgtgatgaatcaaacaaaaatagcaaataaagtgcctcggggaaggctggcctgtcaggcccgtcctgttgatggagagttctggggtgcagggggaaggggccagccctggagcccagtgtctcatccccaaaggccgcaggccccaccgcccaggctgcaggctccggtttctctgggtgcctgcaagctgcagcggcagcaagatgaaaccgcaccgaaggcttccagctaccacggcccggcaggcttcagagcccccgcatccctccaggccaccccggagccacagccacctgccagagcagacccccaaagcaggcttgctcgatgaaaacccctttcctcaagggtgagtgcctgagcctggaagaagctggaagaggatgggtatcaggatgtggtggggggcggggggcggggggctctcgcctgggagaaaccctgggcagtccaggaagacgaggtgcagggtggtggggggggtgggggtggaagcagaggtcggaggcccctgggagaaacttttctgggtagagtgagattcatggccctgcaaggtggggacagcacagaggcatcttcggggccctggtgctttcagggacaagctgctgtgtgctggagtggggccagtgctcagctgacctcagcaggggagcgggtggcaccgtggtggtgaccctgctggtgctgggcacccctgcagcatggctggggtggggctgggggcttctgggccacagggcttctccttgccctcagaacaaggcagccaagggccttcccctcactgctgtgacacatggtggcagagaccagaggcacctaagcccagtcaccccaaggctgccaaagcccaggcacccccacttctgaggctgcccccaacgtgtcccttcccgctacacacagccactgctcagggcccctggaaaggagagaccttggcaccctgctcacaaggcctccgcccagagcatggggtgaggtcgtggagtcgccactgtcctcagctgtgctgctcccaggcctcacctcaacatgctcctgcccgtggcgagccactgcctcctcctcggacagccccacacagccatactccagcggggtgaagacggtcgtgggaacctgaaagcaggtctggagtcagggagggcccttgggccccgaaaaccgaagttccccactgcatgtgacacaaagagcagcgatcacagaccaggaccagatgcgcccagagcaggctgcaagcacagtaggcgacccacctgcccacgcctgcgccacactctcagaactgagccacacacccatgcatgcacacacacgtgtgtacaacacacccacataagcgcacacacacgcatgcccacatctacatgcagacacacagcgcacaaaggcccctcaccccagaagagctagcctcgaactcagcctgtcctaggctgcacgtggcgtcctgctagagaactcacattgtcgtagtccatcagatctgaggacccgccgaagagccgctgcaccaggagcctcccggccatgatcgctatgggtgtcagctcaggccgccccttggggaaggcacaggggggccacgtcagcaccatgtccggggttatatgcagcccctatgccatcaccctttgccctccgagtgggcatctccctttagaaaatccccaacactggcaccgagcatggtgacgtacagcattccccctagagctcgtcctcctgaggggcatcccaaggacctaggtaggttgctcattctcctgtttgctgccctccactctgccctgggaaaggagtccgctgctgatgaggctggccgtgccaccctcacatgctcaagccttctctccaaaccccttctgcacattgctgacctcggagggctgccccatgaccaagctcaaaagagcccctgctaccgttttcattcactggaatccccggctaaaaagggaccccaaagcgttccatgtgctcctgacgtgcagcttgatctgcacgtcacagtccataacaaattccaaatcagaatgtcgctgtgctggagatccctccgtcccagggtgtgcccagccttgggggttccagcaccgtcctctgggatgggctgccaatcaccatggcagcaggaaatgcagatgttgtttggcattccagaaatgcatagagatccgtggagataaactcagagcgcagcctgcgcattccagcaggcctgactaactacggaaacatcccggcgggcggcgcacagcacacaacatctcattaaacaatagcccccgccccgcccacaggctcttcccagccgctcaagggaccactggttgggtgttaactctttggactattcagaacgacctttctgacagagtggatttaatgtttaaataaagaatgcctttgtgtgcgccatgcatttctggcaaaacggtttgaaatgttccagtttccaacacaggagcctgggagctacacacttgcagagggaaaactcagattcccagacagaagggaggcttcccgctgtgcacagagatgcacatggcactgtctcagggtgcagcgcccacaggattcaacagaccctgcaaccagagaccactgcacctacatggtccacaggcagaggctgcgcttgcagaaatcactgagcagctgaaccatccagctaagcaagctggggctgcagggtggctgaggcacatggagccacatgctctgtccacacaatcgggtcggctagatgggccctacaggaccctgcagggtctgcctggagcctcagagtgtgaccttatttggaaataagatctttgcagatacaattaaggtaaggatggaaatgaagtcatcctggattagggtggaccctaagtccaattgcagagaaactgtaagaggcaaatcagggcccagagacacacccaggagactgtcacatgacgatgaggcagagagaggagtgatatagccacaacccgagggacgcctggggcatcctaccccagaggcttccgagggagcctggcccagctgacactttctgacatggagtctcgctctgtcacccaggctggagtgcagtggcacaatcttggctcacggtaacctccgccttcctcctcccgagttcaaatgattctcctgcctcagcctcccgggtagctgggattacagatacgtgccaccacgcctggctaatttttgtatttttttagtagagacggtttcaccatgttggctaggctggtcttgaactcctgacctcaagtaatctgcctgcctcggagtcccaaagtgctgggattacaagcatgagacactgcacccagccccagctgacactttcatttcagactactgccccccaaacgtgagataatccatgtctgttgttctgggccacccgtgtgtggtgatttggtaccacagccccaggacgcagacactgacaggtctcgctacaaagaagctctcagcgaccctccagagccactttcagcagcaggtgctggacacatgcaggacaggccgagcactcctgaggctgccagggtgcagtatcccaagactgaccaccacagtcccttactggggccatgtgtaaggagggctccagagcccccacccaggaaagactggcaccggtctccacttcacagcagcagcagcagctgagagcaaaggacctgccccggtgtgatgcccagagaggcaagccagaggatactgaggcggggagggcggggccaggtgggcccgaactagacctgcctctcaaccctgtggggacaggacggccccaaggccatggtggcatttctaagcctatgcctctagcctacctgccaggggttgaggcctgcgtgcagagctgacccatgccccattcccagcaggcgtctgctgctggtgcttgcagctgtctttagaccatccacactcccaccacagaaaggaaaggaaaggcagagagccgaggcccatgtccaggttgccccagaactccagacaggctggccctggggtttggcccagagcctctgtcatcagagaaagtgtcgtttctctcctacaggacggcagcagccggagcccagcgagcaggggtggtggagcaggcaggggcaggggccctggtcccgggacgcatgccgtacctccaccacgtcaccaatggcgtagatgtggggcacagaggtggcttcccgggagtccaccaggatcttctgagtgtcggggctagtatctaccccagccttctccaaattcagacttctggtgtctgggactcgacctgaaggaaacagagagggggctgaaaggttatcttcagtggctttgacctagagcggttgtgtttaaactgtttctcagaatgtccacttagagaccgggtgcagtggctcctgcctgtaatcccagcactgtaggaggacgaggtgggcaaatcacctgaggtcatgagttcgagaccaggctggccaacatgatgaaaccctgtctcagccaggcgtgatggctcatgcctataatcccaacactttgggaggccgaggcaagtggatcacctgaggtctggagttcaaaaccagcctggccaacatggtgaaaccccatctctactaaaaatacaaaattacctaggcgtagtggtgcacacctatagtcccagctactcgggaggttgaatcgcttgaacccaggaggtggaggctgcagtgagctaagattgcaccattgcgctccagcctgcgcaacaagagcaaaactctgtctcaaaaaaaaaaaaagaaagaaaagaaaagaaagaaaccctgtctctattaaaaatacaaaaatagctgggtgtggtggcatgcacccgtaatcccagctacttgggagggtgaggcatgagaattgcttgaacccgggaggtgtcggttgcagtgagccaagatcacaccactgcacttcagcctgggcgacagagtgagactgtctcaagaaaaaagaatgtccacttagaactggccaaatgtgaagcaccagcagcgtagaggggctcctggcctctgcaggaggtggcaggcaggtctgaaacggacactggtcagatgacagccggcacaggagacaaggcaggggtgccaccggtggaaactggagtcggccttagactggttcctggcacgcgggaaaggaagaggcacttgccaatgctggggctccctgacatcaaagagtgctaagcgcgggactccagaatcttccgcatgcccaggcctcaggccctgctgcagggccaccagcacagtgccagtggctctggtactgacttcatccggagaaaccagcccttcatggggagctgttggcacctggcctgcctggcctccctgcatctgtctgcagcaccacagcctgataccattaggcagtgagatccatcagctcccaggcctcaagagtccagaggggcctccttcaagggacacctgctggctcccaatggcctcctccctatctggacaagctgaagaggagccagccacaccctggactgtaccccaacaatgctcaagtcctgggatctggccctctgcccaggtagggcttgaaggtctctccccattaggagaaagcaagcccccgtaacccgctagtagagggccaggtgagcagagctagcagccgggtctcccacctgctctgtgctgcagcccctcgtggctgcctggcacacagtcccagcctagagacctcagggccaaggggagctgagctaaggggcagtgtccaaactacaccgtgcccattctagggggcagctggctcagctgatcctgctcttgggtgcaaaggccaagaggggcaggggatggccagtccagggggtcagcacagctgccccctgccagtctccacacagcctggggcccggagagagggcaccgcatgggcctcttcatagccgaacagccagcagaggtccctttctcccctaactcagatgggtgtgattttgccaggccagcggatggccacagcagcttttccctcccaaccccaggtgctctcggctcccaggggctcaggatgatccaccaatggcgaaggcaattttgcctcaaaagcatagctcccctgctcatcgtggctgggacaaaccagctgctggccggtatgcgggtggcgcccacctaagcatctggaagctgaagctcccgtgagagggaacccttaagtctccagctgctgtcccggggcaggagtcaaaacataccaacttggctaagccagcttgcgggaggccggctccagcctctgtgctctgctcagccgcaggaattgggtgccgggagggctggcaccggtcggggatcagcccagacacaggggatgccagcccacatcagaggaaggagctgggccccatgggcagggctggggcacgaaggaggggctgtggtccctgcaggccgggggctcacgctcagccgtctggtccctctccaacctggtgtccagcccaccaggcccagcacttcctggtgcctgctccgtgccggaacagaacatctgacgctgcacccacactctcctctgcacgcttgcctggctggtcctgggaagccaagagcactcatcatgttcctcatggtaactatggcactatggcaactacagaccttgcaggtgctgaccaaaccctgtccccaggtcccgaaggaaataaagataaatttaaaagtagtcacaagagataaaagaggcatggaaataggtggcccatccaaagccaggactcttccgcacatgctctgtggatcactctgggaagtcggtgggaatgtaatggagccactaatgtgaaaggcatgacagctggacaggctggatggccaggggagagtgggctgcgcggcacagacacgcctggccctgcagggactccacagcccttcgggaatgaacagcaaaagaagagtgagtggcctgtggcaggcagcaggctcagccctgaggagggcagccgagggcacagtggggttagaagctgggctggtgggacgtggctgggagtgggtgcagggaagaggccagctccacttgggtggggccacgtccctagccgtggccagccctgatggcaggacaccaggccctgagccccactatgggtcttgctgagcaaaggactgggcagtggccagagaagggccagatctccctgctggtgctggacagccaatcaggcgtcctaggccctactggctcaggcctggagccctgcaggaggttggacgacttgtgccaaggtggggacccactggggcccgaatgctgtgagcagcaggatgcaggtggctgtgcccagtcagctccccaccatttccctcctatgccaggataaagcagttgtgcctggtcagctcccgaccatttccctcctatgccaggataaatgtgcactattcaggccatttagggaaagaagggtgcctgcaccggtgtctttcgccctgcatgttgtgctcagagctttcccagctgtgcctgtggcccactgcaggcctccccatggggcggctctgtgctccctgcagctccgtcctcgaagccttggctctggagtgcccagtgcagcatttgccaagtgctgctgaatggcccctcctggggtaggacaggcactctcaaggctctgcttcctagacaccaccaggatggagacctggggcaccagcttgccatgtgtcagttgagttcctggggcagaccctcaaaggaagggcggccagctgagtgggggcttctgggcgcagggcagtccttagactctgttccttcctggggcaggcggcgcacagcactctctgtcatgctgctttaatttgcacttctttgatgactagtaagatgaagtaatttttggccacgtgtttatgaactgtatttcctcttttgtaaattaccagttcctgccttttctcatccatttataggcatcttcaccatgttccttctttgtaagagcttattacgtaatggatacatgacactctggcatattttctgcaaacgacaagggcattaaaattccaggtacagctcttcaggctgtattcatgagcagtcgtgggccacgggattcgtgggcagaggaagggcaccagctctgtgttccttgtgcacatgaagcaggagggctcataggcctgcatgctgtggacttagctgagcggcacagctacatcaagggcaccttgaaggacatgcccctgctgagatggtctccaggatccacaccagtttaagcagcagacagagctgtccatcaccaccaagggcctccacacgggccaatttctgtttgtgtactgtagcaagagggcccagctggacgtcggcagcgtcctccctgcaggcaccacacctgtaccatcaagcgctgcctggaggagaggctgagactggaacttgttagcctgggcctttgagaactacaccgcagtcacctcccctagcccggaaaccaggaagacttacatgaagctgccctccaagaggatcatctcagccaacagagctgtggtcaatgtgggagccagaggtggccgaactgaccagccatcctgaaggcaggccatgcccactacatataaggcaaagaagagctgctgaccatggtgcagagtatggccgcaagccccaaggaacgtcccttcagagatggcaaccactggcacgttggcgaacctgccactgcagagatgtctctgctggtagcaaagtgggtctcattgctgcccactggacttggttcagaattggggctgatgggcccaacaaagtttgtccttctgccaaaaaaatagtaattccaggtacaaatggacgtgctcacttcctatgtatatgtgtggctggcccacaacactgacactcaggaagcactgggctgagcatctctgcagcccggagctgcctccagccccaggcccagcagtgcagcacccctgacgcaggacagcccatctccatgtgtggccagtgctaggaacagccgtgcagggcagccctcctctgatcacaatgagagccccaccagctgctgtcaatggcccaggagatggagggcagccaccatgcttgtccagccagcctggccccaaggagggaccagagaaggctgaagcccaaaaaccacccacacagtcaccatgggtcactcccatctattctgatggacacagggacacggggacggccagccgcatgcagtatcatgcgcctctctcatccatgatgggaagaacaggcatgccctctgatttcacgcccgcctgggacacattttcccaagagaagagcaaggaggcagcgccccaggtgagaggtaagtgccagcaggagtacagcagggtgagccagtggctgtgatccagacagaggcagccagggccaagcactgcgcctgaggacgagggtgtgggagtgggaggctccagggccggtgggcgatgcgaggcgggcacggcttcacacacaggccctgtgggccacctggcgactgtctcatgaggcatgtggcccccagagccagccaccctcacggggcctggcctgccacttgccccagtgaggcaccttggaccaggcacagaggagcgtatgcctttggaactggacttagattcttgaagcttattattttaaaatatttatcttctttttttttttttttctggaatcgcaccttctcaatgagccccgggcccctacccgcagctatgagcccaccagggggaaggggacgcacctgccctgctggcctcaggtcccatcgagacgccatgttagttgaataaatgagtgagcccctgggcctcaatgggacctgattggccacttgctgtgactgccagcagccaccagggacccctaggccgttccagggatgtctcatacccagggcggctccttggggggtgggggtgagcttcccctcaggcagcataagggcctttcctactcaagctgcctatgtgcattatgatgtgtaagaccccacagtcagccttggagtacggcgcagcccccagctcaggcccagaggacccccaggaaggagcgtgctctgtggcgagtggtcattattgctttaacagttattattagaccgggtgcagtggctcacgcctgtaatcccaacactttgggaggctgaggcgggcggatcatgacgtcaggagttcgagaccagcctggctaacacagtgaaaccctgtctctactaaaaatacaaaaattagctgggcgcggtggcgggtgcctgtaatcccagctacttggaaggctgaggcaggagaatcgcttgaattcgggaggtggaggttgcggtgagccagatcgcgctcctgcactccaacctgggcaacagagctagacaccgtctcaaaaacaaacaaaaaacaattattattattattattattattaattatttgaaaagaggtttcactctgttgctcaggctggtcttgaactcctgggctcaaatgatcctcccaccttggcattccaaagtgttgggattacaggcatgagccacctcacccggccctttaacaattgttaacataattgcaattgtaacaggttggctgccccagggcacctgcagacattagagggtgcatggtaatatgcataaatggtgctgacctatctctagaagacttttcaccatgttgttcttttttttttaattggtttccactcagttctaatcattaagtactgaatttgtcatggtaacaagacccagttggacaaccatgtatgcaggtgccggctggcctgtcagatagctgtgggctctggacataagtgtgaactagccctcaagccaagcgtggggcaccaggctggtgggtaagcacagggcgctgcctcctgctactctggcctggcctctgtgaggtgttagcaccaccatgagctagggctgagccaacagtgctgtctcaggagcagcagcgcacgcccggggccacgtggtgtggaggggaaggccgcagccaccgctcataggaagagctccatgaatgttcatcttggccccacttcaaaaaatatcaaactcacaatggaggcagatttgggtctctcttgatgtcattaattacaaactaaatttgcactaaaataaaaaggtgttagactatcaaagaggggcctccgatccgtgtcacctgctcagggatggccactccaccctgagagcatggaggcatgtggatgccagggtcactgctgggcccatccccaccgggaagagcatagccacaaacttggtttcacgcagctgcagcaaggcgcatccctgagagcagtcctgatgggcccaccgcagccccctcgcccgggcagcatccacacccaccgcggcccctaagccccagctgcacccacaccagcacagagggcatccaggaggagccgccccttccctctcaccaggcttaggatgctcccacccatccccagcttggttcttgctttctgccctttcctgctgcctggcactcaacagagggacaatccgcagggacttgtgtagctgagtctgcggtgtacgggagccatcagccgagcacagctgagcaaagacagttgcctgccgtgtacatgccagcaaacagtgcctgggtggagagaggagcccagggctgcagcccaccctggcaacagctcccctcctgggcaccgccagcccccatcatcatctcctgggcaccccagtctctctggctgtggtccaggcacacgtgccacgtgggggagactatacaggggcaggctgtgggggtggcctctgtgtggtgccaagaggaagccgggaagccaagctcccatgctccatgcatgttgtgtttcaggctctgatgctggtttacacacaggtggacatctctgagttatctaagataaagcccaaagaggaaatagcttcagtggctggggtaagatccagacggattccttccctgggtctcgtctcacctgccatatcacaaggccccaggcagacctgtggccaccctccctggcactcaggcacaacagctgcctggctgtgggacccccaggtttagcgagtcccctcctgtgtctgctggctcttctggccatgggcaggactcctgtggtgcagggagggatacgccagagccttcagcatctcaccctcaagagagggacagagaaccatccagaggggctggggacgccaaaggggcacatgaagatctcaacttccagtttttcagggctgcagtccagaggcagtctgtcccttctttaaaaccaaatctaaacttaactgcacttagaagcccctgcactgggaggcgtttgctcaggatgccccagcctggccctgctcccctagacagccagggattcaggccacaactggttaactcagcgggcgaattcgagcccgcagcagtgctggctgactgtcttcactcagcgctgtaatcggcacatctgcagacaggaaatcctcctcactgaagttcccagtctattatctgagacacctggtgtgggcgggtgattcagagacaaacaatgagcgggggccccctgcacagcaattaactgctttaactgctaatatgtttaatccaccacgtggagatcaaggctgcgtcgaggaaggggctctggtcctcctctgcttccagactgcagggcccacttcgcaatgccaatgtccatggtcctcgccagctgcggccaggcgccaggcacacgggcaacgggcagggccagcactcggccccacacgggagctctgtgcagcacctgggccccttctgtgtgtgtgtgcaccgggcacggaggcatccccccttcctgtcggagcccagcttgtgcggacgtagtgcacacccggtacaggaagcagagtcggagatgttggcattgccagctgtgccgcccctagggcgctttattttaacctcccagagtggatcatcctttattgcaagtagaaataaagcttggttaaaggcttatcgtacaaaccagcagaaaacgctcgcagttgctgacctgggaagtggctcctgaatgtttacaaaacctggctctgagcagcagcgaagtcagcacatgcccgagcggcccccagcaggcgcgcagaagccgcgccgccctcgggaagcagggtcagaggccaaggactgtgaaaagcttccacccccagcatcaatcatgccaggcagactgtctgggggatgctcattttgaaagtacaaaaaaataaaacagactcctagcaagggaggatgggcgtgcaggccacggcagctctgctgagtagggaggggcctcgcttgttgcctgccaggctgacgccccggctttccggggacacagcccccggcccattggtctgctacatccctatgggcttggtcgagggctgcccctcggttcaatggcaacagctcccttatgctgtgggtgaacggaggtgtcagcagacagaggaggagggctagggcgcggtgggagggagaaactcgccacctcccctttagagtggagtttatttgggaatgacagtaggaggataaattttgaaagaaaaataaagtggagtttaggatgagaaccatcagtacactccagagtccaaaatgttacctaatccttcgtagtgtttatcataataaacttacttaaaatctacttttacaacgtggctgagaacattgctcttgctgactgatcacctccgggccaagagccctgcgtgcgctcaggcatctcaggtcctccccggtcatcacctctgcgcttgtgtccactgcacaaaagtgaagcctcagccgctccaggctggtttcctttctgatttcccattccgagtgactgcttcagaagtgcatcaccctatgacacagcttgtgcctctgggagccctcccccaggagacactgacccctggccagccccacgcaagcccggttagctgatggaggtggaggcaggtgatctgagagggaccctggctctgatcttgggctctcgcaggggacaacggaccaggctcagcacagaaaggcctcggagaactaacaacactgactaggttgctcccgccttcaacatgcaagttgacagggtgattgggaaaactaggagcctaaactagacggccaggcaccgaggtgggtaggacatctgagcaggcatgctgtgtgtgccgccacccaccctgacgaggacccgcagccctccttgcggcggcccatctgcaatggcctcctctgcagcaggcctgggacagagcagtgtctgggcgatccctgttggctccagctgccccttgccagtcccgtcagacagccccggcccaggcctgggcacaggtatcccctggctgtgtccacactccccacacctgctcggccactgccccatgcaaaaccggacctacacctgacagagagcaagaaggtgagaccagactgtgcccagcaagttgtagccagcccacgcctggccgggaaacgcccaggcctctgcccagcactggaagggtgatgtctttggaagccttcgaaatgtgacttctggaaaggcctgcaaaatgccactcctggcatgtgatgacctgccaggcccaaagggacccactgggaaacactgaaagccacgagaaggctggacagaactttaaaaactctgtgtcatttttatgtgctgaaaacaggcggcttgtgcacacccatgttcacagcagcatgatccacaacagccaaaagacggaagcaacctaagtgtccactgacagataatggacacacatacaactcagccttcaacaggaaggaaatgctggcacatgctacacaaatgctaactctaacaaatgctgcaacatggatgcaccctgaaaacattgtgctaagagaaatgagccagtcacaaaaggacaaacactgcatgattctacttacatgaagtccctcgaggagtcagatccatagagacacacagtgaagggtgagtgcccgggcagcagggagtgagtgtttaatggggacagagctcagtttggagataatggaaaagttctagagatggatggtcatgctgcttgtacaatatgaacgtacttaacaccactgaactatatactttaaaatgcttaagatgatgaatttgatgttatgtgtatgtcaccataatttttaaaactttcaaatccatatcatttttatgttaaaaacaacaaactagcttggctgggcacagtagctcaaacctgtaatcccagcacttagaaggctgagatgggaagattgattgagcctgggaggtggaggctgcagtgagctatgatcacaccaccacactcctcctaggcaacagagagagaccctgtttcacacgcaaaaaaagaaaaaaacctagctggaaagcctgaagcagcaaaacatttaatatgctaaagaaaaaatacatactggccaggtgcggtggctcacacctgtaatctcagtactttgggaggccaaggcaggtggatcacaaggtcaggagattgagaccatcctggcctacatggtgaaaccccgtctctactaaaaatacaaaaattagtcaggtgtagtggtgggcgcctgtagccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctggggatggcaagatgggcacagcctagtgtgagtgccgccccacaggccttcacggttgctctcgaggtgcactggggagcggccaacccgcctggcagccagcaggatgggggagccctgggaggtgacaggaagtggggcaaagattctccatgcacctcggggagaccagagacagagcgtgtggctcgacgtgcccttacctatggcccacaggacggtgtcaaaggtgcccgtgtcctccttgccggtggtgctgtcctcccaggtgacctgcagctggccatcagggagcctcctgacccgcgagggggcacagcccctcaggaaccgggtgccatgagatgccatgtgctctatgaccatggaggacatttgctgcaaagcacaagaagacaggccatgaagaccaggtggccgtgggagagaggctctggccctgccctgctctcgaaggcctcaatgaagggcggagaggggtctgtgcggaagacggggtgagacaccctgccccctgctctacgtcctcttgctctctgtggagtgtctagcccctgtcctggctccaagtcctcaaccctgggccctatggtcaggattcactcagcctgtgggctcctctctagatgctaattaactaagtcttcatcagccagatacggtcacacctgtaatcccaaccttttgggaggctgaagtgggagaatccctcaagcccaggagtttgaggctgcaatgaactgtgatcacaccactgcactccagcctgggcgacagagtgagactctatctctaaaagaaaaaataagcaaggccgggtgcgatggctcacacctgtgatcccagcactttgagaagctgaggcgggcggatcacgaggtcaggagatagagatcatcctggctaacacggtgaaacactgtctctactaaaaaacacaaaaaattagccaggcgtggtggcaggtacctgtagttccagctaactgggaggctgaggcaggagaatggcgtgaacccgggaggtggagcttgcagtgagccgagattgtgccactgcactccagcctgggtgacagagtgagactctgtctcaaaccaaaaaaaaagaaagaaaaaaaagaaaaacaaccaaatcctggtacatctacacatttctttaaaaaacaaaaacaaaaaacttagtcttcactaaaaccaatggcagagaagcgtgccttcccccaggagctgtgccctggtccaacaagatggcccctgctcctggcccacccctccacatgtggccaacatgcccctctgccatccaggagccaggagggtaggtaggagactctgctcccgcctagaaatgtaggcacagcaggctcaggtccagatcagggacagagagagtcctgcttctccctcccggcccaggaggcctgtgcgccccaagtccagctacagatgggggccctgttcccaggacaatggggacttgcacggaccagcagtgaagctggccacagcttctggtttcaagaggagaaaaacagtcactgctaacatcctctgacacctgtgcgggtgtgccagctggctctagatggcgtgtgtgggagtctggcccgccgggcagggctggctgtgctgcagaggggctgccgcacaggctgttcatcactcctgcacccctccagaggcctggagggcatggccatcccaggctctgagggagaaccatggagcctgtccaggacacagggtccctcgcccctcagcctggctgcctagactgtgcatcctccttgcctgggcacggcccccattctgcaggcccctttcctcctccgtccactgccagctcaccctccccacatctgaaggctctgaggccttcctagacactgcgtccctaccacagggctcggtgggtttgcactgagggacatgatgggagtgtgccatagctttaggatggaacaacacatggccacacgggtggagggacacgtctctgagtcagcctgggggtggcactgggagtctggagatgacaggcctggctcctcccacctcaggtgacctcctcaggctctgtgagctgagggtcggccgaggacctgtagcagggcctgcagatctgcacagctcaccctgcaaggggcctccttcgtggcagtcatggagtgtttgacatctccacaatgacaactccagacttctattttaacaggagactttcccttgaagagtttttagctaaaaaaagaaaatctctattgctccaatctaggagctcgtcctgctggccacatgagtgtgtgtaccccagacacagatgaaggccactgtacacagcgcacctgtccagaagccaagatcccacgggctgtctcggagccagcgctgccctgtgtccctcaccccagctcacacattacagcttatttcacccccactccctcagaggggacaggcaaggggagagcagggagttgggggtctctgaggtggggctaacacttctgcagcacacaccggcctcttactaatgggacgacccggagggtgacctgctctgccggcacaaggctgggctgagcctcccttcactgtgcctgtggtcggctggaggcctctgtgcagctgtgcgccccactgccaccctcctccctcgctccggccgagtgtctgcatatttcctggacaacctcctcatccaattcaagggttatctctaaagattcaggcatcactcgtggcccatgactgcactgcacctgcctgggagggggctgtgggaggaaggcctcagagccacaggggcgggagctggggcctccagcactacctggtcgaagccgcggagggggatgctgcgcatcatgatggtggtgtccagcccaatcccggtgaggaagccagcacactccagggccacatctgtggggtgccagctaaggagcactgtagatcccaattttggaaatgatgggacaacaccccagggccctgtgccacagcccacaccccacccatccatggctggccctggaggaggctcccaactcaagacccccacctccacatctcaagtgcacaggctggggttagcaaggagccgccaagcagcacccacggactaggccggcctctggcctctgctcccatgtgctgtccatcccggctccagggcgaggcctgcatcctggtggattccagttgggatggagaggagtggctggttcagggaggacctcagccacgggagatgccaggcagctgctttcttccacctgtgctctcagccagcggcttggggcttttttttttttttttttttttgagatggagtctcattctgttgcctaggctggagtgcagtggcatgatctcagctcacagcaacgtctgcctcccaggttcaagcggttcccctgcctcagcctcccaagtagctgggactacaggcatgagccaccgcgcccggccagggactttcatctccctcagatgtccccttgaccccaggccctcctgcagctcctctcctgaccctccctgtctaattgtcccttctgaagcaatgggtccaggctggggctgctcttgagggaggacagcccagctgcctcatggccatgtccagctgtcccagctcaggaagagcctccaggaatccctggccagaggtcagcctcaaactgtccccaggcacagtagatcctccacgccgagaggcccagtaagtgccgatctgaggcagcaaagagcctgccggaagggcgggtggcagggagggactcaagggaaggagtgtccagttcccaggacggccacctgcacgcttgcaaaggatacagctggccccgaccaccaacctgttagagaaacagagagagagcacatgtaaagctgaggcccttattgaccaagtgcagtcagagcagaaccccgcagcctttgcccaggcccttggtcagctcgtgggctccaaggttactgttcaaacagcttgccccaggggacaaagcccactttccaaggctacactgtcaagcatgttgtgaatcagcaaatcgcctggtggtgaagggcgtgtgtgtcagtgacaagtggtacctgtcccctggaaggcacccggaggcatggagaaacatccaccagagcagcacatggctttccttctctccccccggggcctcctgggctagggtggaagctgggagatgcttggcaggatggggaggccaccagaccgcaagggaagacatcatctgagcaaagcactctcaagaccacagaaggctgggcccttccatgtgccagaggcacatccaaccctatcacagctaggcgcagggccaggagggccagctccccagagaggggactgaaggaccccagggacaagggaggcagcacaggacactgcgaccagcagtcattggaaatatttgctcttgtagtgaaaaccctctattgttcaaccccacactccacatgtgttttgcatgcacatgtactcacgcacacttgtatgtgcacacatgccacacacctgcatgcacatactcttacacgggcacaaatgtacacacacacgcacatactcgcatgggtacattcattcatatatacatatgcacacactcatgtagacacatgcatgcacacacatgcaaacgggcacagaacctaacacgaacaagaactcccagcggggcagctgcacgtgggtgggctcccacattacccttcagtctttgaacaagaggaggtgatgtaaggacggataagcccaatgtcattgctaatcccagcaggtactaatgatataattccatttcaaaacacggtgtatcccttggaatcattctgcaggtgccctgcgggaagcatctggcatgcagcttcctcactgtggctggggacagaaccgcaccactgtcaggattagggtgagcagacagagctctgttggccggctgagcacaaggtggttacatgcctcactcagcatgtgaggacagcgaagggggaccctgggacccccagccaagcaggattgcagagatgcattcccagccccgctcagggccggcaacacttgggaaacaggcaccacggtatgcacgcacttccacacatgcacacacacataggcaccacatacacatctctacacggaagtgcacttccaaaatggcgaaaccaaactctttttggacttgctatatgcagtgaaaggtacaagcttttgtttaagatatgaagttatggccaggtgcggtggctcacgcctgtaatcccagcactttgggaggccgaagcaggcagatcacgaggtcaggagatcgagaccatcctggctaacatggtgaaaccccatctctactaaaaatacaaaaaattagctgagcatggcgatgtgcgcctgtagtcccagctgctggggaggccgagacaggagaatggtgtaaacccaggaggtggagcttgcagtgagccaagatcgtgtcactgcactccagcctgggcaacagagcaagactccatcacaaaaaaaaaaaaaagatatgaagttatgagttactgcaaatataaacagaactctgctgctttgcatatcctgccctaaatgcaagggtgtaactgggcgagagcccattgtgtggtgccctttgccccctgctcccagaggtggctgtgcatgggctagatgcttcctgctgggctgtgcaggcactggcagagtgaggccaatgcatcccctctgtgggcagctgggcccctgcacgtcagggccttcctggccctgaaggccaacccttctccaggaatgggccctgcagctgcaggatgggggccaggctgctctccgggcctcctagctcattgctagggatacagcaacacaccctcctgattttgccacaaatgtttgctgtctctgccaccgacgtgtacatccccacctcctacacgatgctgacccaccaggcctggattggagcgggggcaggtgactctccaggccctccctcggagtcccccagtgcccgggcctcctgtcctggcacccacggggcacaggagaagctcccgcctcaagggccaccttcaaagtcacaggtgcccccatccctcagctgccagctctgaatcagcaactgagggtacagctaggaggaggtgggtgcagtgggcatattcccgagtgggcatccttgaccctatgtgttcggctgaaatctctcaacaaaagctcacgtctcgctcgtgtggagggtcattttgggcctcttcttgttgtcatgagcaaggattattgacagcattggttttcactgtacgcctccccgcattgatcaaattatgtgaatgtttaccctttgaagaatgcaggatacgagaattccaacagagaactccgttcagaccagctaaagtaaaaaaatgcccgagcaaaataagacagacaccaaagcctccagatcacagggatagagagtacccaaagacagggacctacagacaccttcttcaggccattcacggcccagcaggggtagggacagacaggaacgtggtgcagcaaccaactcaagccatgactggccacaggaagtcagaggtgctggccacagaagtcaggggaccagctcacaggacctgggggtagggggctggaaccactcaacttaccgctgcattaaaagacccagaggttgggtgcggtgggtcatgtgtgcaatcccagcactctgggaggccaaggtggacagactgcttgagcccgggagttcaagaccagcctgagcaatacagcttgtccccatctctacaaactaaaaaaattactggggcatggtggtatgcacctgtagtcccggctactcgggaggctgaggaaggaggatcacttgagcctaggagtttgaggctgcagtaagctgcactccagcccgggaaacagagtgagaccctgtctctaaaacaaacaaaacaaaacaaataaaaatcagttttccatgtgatcccagcagctcagctctctgtgctttttggtgtgcaaacattttccaaagaggcataataactactgcaggatgagcctaatcacagggcaggctttcttgttcaaaattggaatggggggaggaagcagaaacaaaagcattaattcaggcccacgaagcctaggcttaaagagcaatccatctgcctcttgagcttgaaggcctgctctccagagggaatactcacacaaagtgagtctcatgggaggcacctggccccttggaggtcctgccagcccaggaaataccagatgggccgccaagctgcagatgccccagggaggcagcacagggctgggggtgctacgaaggcctccttccccggcttggctggaaccccgccgccccacccaacccctcaggggcagatgctgggccggagcctctgtgtgctggccctgtaacaaatgccactgaaagccctaccttgtcatgtcttagccacagggacgcacacagagaggtggcgggggctttgcagtctggtaacaagccccaggaggacagctggtctccctattgctgaacacaaggacatcccatcacaccagcggaatgtgccacttaaattaaattttctcccaaatggctgtggttcttcccaagataaaatttatcttcttccctcttgtgcttaggaagagagaaaaatgatcgcagtacctggctggcttccggacttcctaagggtcaaataaaagctctttccatgacacactgacaggcagccttaaaccagcccaagttataaaaacactctgcctcttggagccccaggagtgcgaggacagacagcagcaggctggtggagcagcctcagagggtggacaggcctggctggctgcagcccctcccccagggcccagtgtgtgggctggtcagcccctgagccagcctggcagctgcaggagaggctggccccatgctctgtaaacccccacggggacctgggcaggggctacagagctggcagcaggaacaggcagaccctggttgtttccgggaagcagtacctccgttatcggacctgagaggaggctgcggtctcattcacgccctcggccccatcccagtgttgccagctcagagccctgctttgcagaaagcggacctacagacacagcaagagggaggactagaatagagggaccacaattccctatattggggttagggcacctgagctccaaaacctggcactgagggagaagacgaagcccagggccgtgggtgtgcaagaggcagagacaaggcacactggcggggcccaagtccctgccgggtgcggaggcttcccggtggaggcagccctccaggtcaggaagtggcaggaagattgtgcggctgtgggactggagttggagctcagctccttggccccccttaattgccaggcccctctgggcctcgggctcctcttggctgcacttggatcccgacccccagtgcctgcctctgtaaaggagctccccggtgtgggctcaccatcctcgccttccacattcctccacctgccgggggcttgctctgtggaatggaaggtttggtttgcaaggctgcatgccccctctgagcctagtcatttggggtcacgtgcccctccgcacccctgcctccctgcagtggccattgttcccagaggggctccactgcctgcccagggtcactgtacctccccagaaacctcctctcttcttcaacctgtcttgcagttccagagaaggaaagacacaacacagcagaaaaggcaaacgggctggcacaaggcgggcatctgcatggcagaggcggagcaggagccgacctggagtccttcccagggtccccaccaagactgggaggacagtcccttgcgccagggcgtggctatgggagtggggcagccagaacgtcccccgccccaccccagtgcactcaagggtcctgctcacccacccacaagctcacactgctttttcaggagttttctgagttttctgcacgtcttcctcaccctcctaggttacaaaccaggtgctcagcccactctggtcaacaggtatggccccattttgccagcatatggctgtttagtgaagtgcactgtttaattctgtctccccttgactgagcttggacacgatccccctgcctctgccatctgtccagccctgggctccctaagacctggatgcaaacaaaggaggaagggggctcccaacttggggcccgaggtgcactgtgatgcctgagtggcctctctggggcaaaagtggcatggtacgaccttgcaggctgggtcccaggccccactgtgggcaccactcgccagatctggagctcccggcagtgggccccacacagacgtgcgctgaaaggagttcctggtggcagcctgtgcctgtagtagagagggacgagggaggcctcgtgcacgccgcagagcccaccgagggcctggggccagggggacagggagcctccttggtggaggagccaaccaggggacagagtgcccactgcaggaggggcactgtgatgccaggcaccgtgagttgcgcacctggcctccaggatgggaccaggtagaaatgtcccacccgactacgggaggcactcaggggccaggggagcagccccggggtccatattaatttcagctccattttaaaggcgagttaaaataaacatggggaatatttataaggcaaataaatctggcagaaacagcccctccaagtgtgagtggaggcctcccctcagccccagcccaagctgataaaatacagaaatgctactgtagaccctccgggcttattttgactgcagcagaggaatgtaacatgtaaacactgactcccatattacactgttacaacttgcattaacagcgccggacaaaagccgcattttcacagaagcatcgtacagggatatatctccagcttaatttttaaaaaaaccatttcctcacataaatcatgctcagaatgaaacgggtgactgatacattgcaaacactttttttcttaaacaataacatacctagattccttctaaacgaaagagctttaaaaaaaatcttctaaatgttttttttctgaagaaaataaacactgcagtttcttttctgaacaaaatatctggagctgtgtcttcccggccgagccagctgcccccagcacagggttgcagaggagcgctccccaagccccagccaccttgctagggagacagcaaggccagggcacccagagcaccgggccccctccccaggcccaagcgggcagcctctgaggggaacaggcacaacgagggtggtgaaagtgctgggctgcagtgaccgtcaccgaagaccccagtacatcgaggggcccagcagacatcctggggctgccagacatccaaggccatttccctgaaggtccagcagacaaagcatcctgcaggggctggaggggcatccagactccacccagagaagcctacgtgaaagacaaccagaggcacaggcagaactcaggacgccgagtgagaacagtgcctcgagatgggcactggggcccgggcaacccatctccaccacaccgcagaagaagtgcagccagcccaaggaagtaaaagaaaatccgacttgtggacgcccataaggaaaatacagggcttaaaaaaaaaaaaaaaaaatcttgggggtggggcaggcctttctgaacatgcaataaatcaaaaagccactaagtgtaaaagatttaagttacattaaaaaaaacttaaaccatttgtacatcacacaagttaaaagacactagaagctgagaaaatctgcaccacaagcgacagaggatcacatccctaatacacaaaccagctggagggtaagaagagataagagaagagaaaagccagacgtgaaagtggacaaggaccatgctggcgatttgtgcagcacacatgggcatgctcacagacacgctcatctcaaatgaggctgtgacacgaggcttttcaggtaaatgtgtgaaaagaccactgatcacagcaaatgcaaacagagtcagatcatgtgtaactcagcagatagtcaaagattaaaaaaacagtctgggtgccgtagctcacacctgtaatcccagcactttgaggggccagggtgatcacttgagcccaggagttcaagactagcctgggccacatagcgagtccttgccctaaaaaaaataatcattagctgggcgtggtggcgagcgcctgtaatcccagctactcaggaggctgaggcaggagaattgcttgaatccaggagatcaaggctgcagcgagccatgatcgcaccactgcactccagcctgggcgacagagcaagaccctgtctcaaagataaaaaaacagataacccagaaattatggcataacaggaaaaagtgattggtgtgacaacagaaaaacttaaaatttctgcatgaaatactatcaccaagtccaaagacaaaccacgatcagtgggtccaatggaaggcagcaggcagtcgatggaaaccagcacaagctcagcacagtctcaggagagtgtgggcgccgtgggtagcagtgaccactctcaggagagtgtgggcgccgtgggtagcagtgaccgctctcaggagggtgtgggcgccgtggatagcagtgacggctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgccgtggatagcagtgacggctctcaggagagtgtgggcgccatgggtagcagtgacggctctcaggagagtgtgggcaccatgggtagcactgaccgctctcaggagagtgtgggcgcaccatgagtagcagtgaccgctctcaggagagtgtgggcgccgtgagtagcagtgaccgctctcaggagagtgtgggcgccgtgggtagcagtgaccgctctcaggagggtgtgggcgccgtggatagcagtgaccgctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgctgtgagtagcagtgaccgctctcaggagagtgtgggtgcaccgtgggtagcagtgaccgctctcaggagagtgtgggcgccgtgggtagcagtgaccgctctcaggagagtgtgggcgccgtgggtagcagtgaccgctctcaggagtgtgggcgccgtggatagcagtgaccgctctcaggagagtgtgggcgcaccatgagtagcagtgaccgctctcaggagagtgtgggcgccgtgggtagcagtgaccgctctcaggagagtgtgggcgcaccatgggtagcagcgaccgctctcaggagagtgtgggcgccgtgggtagcagtgaccgctctcaggagagtgtgggcaccgtgggtagcagtgaccgctctcaggagagtgtgggcgccatgggtagcagtgaccgctctcaggagagtgtgggcgccgtgggtagcagtgaccgctctcaggagagtgtgggcacaccatgggtagcagtgacagctctcaggagagtgtgggcgccgtgggtagcagtgacagctctcaggagagtgtgggcgccgtggggagcagtgaccgttctcaggagagtgtgggcgccgtgggtagcagtgaccgctctcaggagagtgtgggcgccgtgggtagcagtgactgctctcaggagagtgtgggtgcaccgtgggtagcagtgaccgctctcaggagagtgtgggcgccgtgggtagcagtgactgctctcaggagagtgtgggcgccatgggtagcagtgaccactgcccaggccaggggtatgggaggagaggctcctttctgttttgtgtcttatcaaaaagctgatgcctgagttaccaaggacagggaagcaggcagagtacacatggaattggcctgtcagcacaaagtgttaagacggaagggcagctccccttgtaaagcgtataagaccacctcacagccactaggatggccactgtcaaaaaaacagaaaacatcaagaaaacagtttaaaggaaaaaataaaaattaaagaaagaaaaacagaaaacaacatgcactggcgaggatgtggggagcccagagtcctcctgaactgctggtgagaatgtaagatggtgtgggcgctgttgggaacaggatggaggttcctcaagaccataagatccagcaatcccacttctgggtttgcatccaaaagaactgaaaggtcttcaagaggtatttgcacacctatgttcacggcagcactgctcacaacagccaagaagcagaggcaacttgggtgtccactgacagatgaatggataaacaaaatgtggtgtgcctgtacaatggaatattactcagtcttaaaaagaaggaaatgcagatacaacatggatgaaaagagttccagacatggatagtggtgatggtttcacgacattattaatacatttaataccattgaactgtatacttaaaaatggttaacgtgggctgggcgtggtggctcacccctgtaatcccagcactttggaaggccaaggcaggtggatcacctgaggtcaggagtttgagaccagcctggccaacatggtgaaaccccatctccactaaaaacacaaaaaattagcggggtgtggtggcagacacctgtagtcccggctactcagagggctgagacaggagaatcgcttgaacccgggaggcagaggttgcagtgagccgagatcgcaccactgcactccagcctgggcaacagagtgagactctgtttcaaaaaaaaaaaaaaaaaaggttaaagtggtaaattttatactatgtctgttttatcacaatgaataattgggaaaatgtgtcagaagcacttctgatggtaaacagatgcacctccaaggttttcactgcagcattgataatgatgaagaagagaaactactgagatgctcattaacaagagaaaggtcaaaggaactataccacatccattcaagggaatccagtcctgaccccacacaaagatgccccgtgaagtgtgaaacaatgacaagcagagcatgtgacacaccactcacacacacacacaccactcacacacacacaccacacacacacataaccactcacacactactcacatacacacaccacacacacacaccacacacaccactcacacacacacaccacacacaccactcacacaccactcacatacacacaccattcacacacacaccactcacacacactactcacacacactgctcacacacaccacacacaccacgcacacacaccactcacacacacaccacacacacccacacccttcacacacacacaccacacacaccacacacacaccactcacacacaccactcacacacacaccacacaccacacacacccacacccttcacacacacaccacacacacaccactcacacacaccactcacacacacacacaccacacacccacacccttcacacacacacaccactcacacaccacacacacacaccactcacacacacaccacacacaccattcacacacacacaccacacacatctgcacgcacaccatgcacattcgggcacacacagaagtgggacccttttccactgatattttctcctggggaaggctcgagactgctattgaccaagcctctgccgccctctggtggtctctctgctccctgccaacatgaagtctccacaccccacaggcaggagctgcctggacctgggacctcgggatggcccactctgtgggcatcggaatgcacttagtgactctgcacctgctcccatggggagtgagagccacttgcacgctgctagcctcccttccacaatcaagatgttgtttctgaggcctttggagtctttgctagatttcagggaaacccaatgtacaaatcagaagacagtgagggtgttagatgagggctgggatagggattgctggctctcccctccttaatgttctccctgatgtccttgaggggacccactggaaccccagggctcctgggaaccccatttgacaaccactgacctagataacaaacagctgactccatttatatggcagtcctgttattgttattacctccaaggcagccacaggacagagtaaatcaacagccctgcagaggggcacaagtcacaggtttattgtttagttttgagacaaggtctcactctcccaggctgagcgcagtggtgcaatcacagctcactgcagcctcaacctcctgggctcaagcaatcctcccacctaaagcctcccaagtagctgggactacaggtgcacagtactatgctcggttaatattttcagatttttgtaggctgggtgtggtggctcacgcttgtaatcccagcactttaggaggacgaggtgggcggatcacctgaggtcaggagttcaagaccagcctgaccaagatggtgaaaccccatttctactaaaaatacaaaaattagccagatgtggtggtgggcgcctgtaatttcagctactttggaggctgaagcaggagaatcacttgaacctgggaggcagggattgcagtgagccaagattgggccattgcaattcagtttgggggacagagtgagaattcacctaaaaaaaaaagccaaaaaaaaaaccaaaacagatttttgtagagtagaggtctcactatattgcccaggctgatgctgatctcgaactcctggcctcaagcaatcctcccgctcagtctcccaaagtgctaggctaacaagcatgagccaccacacctggccacaaataacaggccttttttccttcttttgggtaaaccggaaagaaagccccaggagcccagcaccagcacaggctctaagggtccagtgctcactctggtgaacaaaaagaggaccccaccaagcacgcgcaggccttacgtttttccaggggattccttcagccagaagatgtcatcacttgtgattccatattccaaggcaccttcgatctgtcaagacagaaatgaccccttggacaagagctccatttggcctgtcctagggcttccttaaagaggatgccagctttgcagaatcaagcagagctttcccagggcacacatgcacagggcttccctgctgccagtccttgtctgcaggctgtggcctctttggggctgcaggtggcctgtctgcatctaagctgctgcactccaggtcccggtgccctcgcagggtacctttcccctctgttccccaggaccctccccttgaccctggttcagagcaggatacagggcctgaggtgggtacagcaactgcaggggccatacaggcagacagctgggacccctcaagtctgcccgggttctggacagacacatcaaacagacaggggcatgcagccccagggagcaacacctgggttctgggggatccaaactcagagagaggaagtggggagagaacaggtcagcaaatcagggccagcagagctcaggtgtgtctgcgcggcaggggtggcctacaaggccagccagaggagaggaggcacagggggtaagtgccacaggctgaggtgggcagggactgaggggcagctctgagggcacctggctgaagccaggacggacttcacactctcgagggctggcccgggtgggctctgagcccagaaatcatacaggtcacctgaagaggggcggccaagcaggtgggaggcccagggtgaacgtccccttagcggccatgagaacaagatgtgctggtggaggaagcggatctcaaacagtttatgcttccaactggcaaaaaaaaataaagtcaggaatttctcaggtttactcaaggaaaaccgaaaggtctggcaatcaaagggactaaaacgcaagcaagccttggcagacaccctgggagggcgtggcagggagagcgaagcagccctgagctgcctgcctcctaaggaccaggagcgcctgctggatcccctgtgagcccaaagagccgtcagcagctgcccgtgaggtgcagagcagggccgggccaggccagggcccctgtgcagtgctccctggtgcggatgcacgtgcagctctgcctggggcctcagagaaacccaatgaccgctgggctgctggaagctggctgtggccttctttaagcagaaccaccatgagcccagctgccaggagaggggatcactgggaccctgtctgcagcagctgccttgaacaactgcacagtgtcatcctacaaagtcacgcagccctgagccccacctctgtgcataagcaacctgccccctctagaggctgctgtggctgcctggcggccagacaagtcccacggcctctaaggactgggggtgcttgtgctcctcggggccgctcctttccctgtttccacagtaagcacaggacgaagtggaggctggggtcacatccaagaagtggcagaacctccccttgctctgcctccaccggactgcccctgggtctaagtcagaggtggtgtggcctccaggccgagagagccgtggtcttcaagagcttggctgcagcctacttagaggcttggagcaggcggcacacggttccctgggagacccgtggggactggtctcagccaaacctctctgctcacccccagcccatttgctttccctgctgcagctgccccccaacccctcaccccggggccccttcctcaactctgcccccacaacccacaagactgggccaggagttattcacctctctgttaaaaacagcgataaaactggcaagaactgggagattcagaattatggaaattaaccacaggcttgcagcaacacagggaacatttaaagtcaggaaaaacagctgaagctgagtgagaatgggaactccagggtgttttaactcactctggtcccactcccacctcagcggcagccctgaacagtgatgtgtcagagagagcagaactcagctggggtctttcaaagcccccccacaaagaagagtcagagtcagcaactatagggtcatcttcatccaacttcaccggagctcagccagggctaaaagcctttctctgggggcatttgtctgaggttttcttctcacagctgcctgaggggataggtaacagttagagccaacaacagactgcccaaaaagcttcaaaggaaaagccaaagtatgagatgtctgctggagctttgaaaggttccagcatattcctgggaacctaggccaggcgcatgcacagcactgtgcacacatcaggaaggaccaacgaggccctgaaccctcacctccagctgaccttgatctctgcagaagcaggaagtgaaggctagggcagagctgtctgctgcctgttgagtgtggaaggcatcccctccaaacgcacacagagccctcagcaaagaccgggagagttcttagtttagggaaatctccatgcagttcttagctgaccactaagctaaccaagtaaagacttcagtggccacatacatcaaagaataagagtctacaaagtcagttccgaaaagtcaccaaataagcagctgtaacaacagaatcctggggcagagggagaatctggtttccaaagttatcgcattaaattatttgaaatgttcagctttcaataaaaaaattacaagatacgtgaagaaacaagaaaccatgacccttacaccccactggaaggaatgtaaaacacagtcattgtggaaaacagtctgaggttccttgaaacgttccttgaaagattcaacataaagttaccacatgacccagcagttctgctcctaagtgtaacccaagagaagtgaaaactgaagtccaccaaaaaacttctttgcagatgttcacagcggcactattcataatagctaaaaagtggaaataacacatgtgtttatccaagcaagtagataaacaaagtgtggtctatccatacaatggaatagtatctagccataaaaaggaatgatactgacacacactacaatgtaggtgaacctggaggatgttatgctcagtgaagtaagccagtcactaagggacacacacatacgagtcactaagggacacacacgtaccagttacatgagaaggacttacatgtacgatttcacttacacgaggtgcctagtgttgtcacattcatagagacagaaagtaggtggtggtttctaggggctgggggaggaggcgctggggagtagggtttaatgggaatagtttcagttcagggatgatggaaggagttctggcaatggatggtggtgactgatggccgcacagctctgtgaatgtactaaaaaccactgaattgtaccctaaaaaaggctaaattttatagcgtgtgaattttatttcaaactttttttaaactgggggacgtgaaggaggaagatgaagaatgaggcttatatcctgaatgttccaacattctgaggctgaagggaaaagggggaatcagcaatggagacttaggaagcaggatcctggtgtggaaggggacagatccagcggggcagggggagagcagaacgagagctgtcctgaggatctggcagcgtggaggccactggggaccccacatttcagcagtgtggattcaagagaattggaaagcagaaagtgatgatagtgagtatagggggaaagggtgtgcaagctgctgctgtgggaagcacgtgtgtaaaaacgtatccctcaaagaggccgggaatgggccacggcagcagggacgctatgctctggggacactcacgtgcgtggggtatctcggccgccctccagtagcaatgatgatgtgatcggctgacagcagaatctgaggagaaaaagagaaagccgtgggtcagacaggtgcatggtgatcaccccaccggagggcctgagcaccacagaccttggccagcagttcccacggcccctgccctgtagcgtggacccttggccagcagttcagaggccctatggagctggaatcccatcaaccatcagcctggcaggagggggacaggcagaaagcacagggagatgttctaactccaagcacttcaaggcaccctcaaatccccaaaaaatcctgcaaaaagggtgtggtcaccaaccctgttgccatgccactccgagcagcagggcagcaaattatttgatcacgttaaagacaagtgcccagcctcaaaagaagccacctttttgattccagcagcacgtgttactaagaacagcacccaggccaaacacagctgcagttggtgcccaaggtctgcagaagggtccacaaggagccacgcgagtaagtcagatgctcacctctttcccacctttggcaacgccgcaaaccgtgtgctcgtcaacaaagctggctttgatgttaaagtacttgacttttctgaaagataaagataagattttcaaacacttcctctgcaaattaaacctcaccaactggatcaatagggaacactggtaaaagggagctccagcccccagcagggcctggtgctgtggctcagatggaccaagaggtaagcggcaaccatgctgagaagcatggaggggatgtgggggcacctcgcctgtcccccagggatcccagggacatgttaaccacaggtgtcaaagcagggacggaagccagctcagcacggtcctaagaggccacgtacagccctggtgtgcagcaagaggtggctggacctctcttggggacagtcctcatcacccggacatgttccagcagggagctgtggtgcccaccagatggtgtcaccttctgatttcaggggtgtggtaacaccaagagaacgggcatgacaaggctggcaaaacagtggctgggagcatagtgcacagaaacaaatgacccacgctttcttttcttttttttttttctgagtcaaagtctcactctgtcgcccaggctggagttcagtggcacgatcttggctcactgcaatctccacctcccaggttcaagccattctcttgcctcagctcttgcctcagcctcctgagaagctgggattacaggcttgcgccaccacgcctggctaatttttgtatttttagtagagacggggtttcgccatgttggccaggctggtcttgaactcctgacctcaagtgatccacccacctcagcctcccaaagtgctaggattacaggcatgagccaccgcgccccacccttttttttttttttaaagacatcttctcactctgtcacccaggctggagtgcagtggcatgatcatagctcacggaagccttgtttcaagtaactggaactataggcatgggcaaccatacctggctagttcattttattttttgtagggatgtagcaataaaactatgttgctcaggctggtctccaactcctgggctcaagtgatcctcccacctcagcctcccaaagtgctaggattacaggcatgagccactgcacccgaccaacactttctaatgacaaaaggaccgtgctgcagcaagggttctgggaaggctctgcctcctgcttgagcctgccttctccccactggcaagcctgtgcctctatgggctgtctgagctgcgtgaagttcctacagcaagagcccttcaatcacctcgacagccaggaagctgccacgggacacagccgggcaatgctcatggcagcacttttcagaagagtgaaaaagcagaaacagcccaggtgcgccccagcctccttctgcaggtggctccggagcaggcagtgggctgggcctgtttggtgcccgtccaggagctgcccagggcagggaggagggagggcagagcctgctgtccccaggaaactgtaccaggggatacagagccccacagagaaacacagaaatgccacagcacaatgtggcttagctccctggataggggagagcttgtgaggtccaggtggagggcaagcagttggcttcctggctccactttcctggatttagtgagcacaaaactgctgcctgctgtgaagccccaggaagacccgccctggggccaagcaaatggtgcatgaggagagccaccagacctctgcgggaccactgtcccctccacagccccgggagaaaggctgggccagaggcggtaccagtttcaggcatctgctgtgctggcagctgagccccaggagaaggttgtaggccaggggagcataggcctctgtgctggagatccccaggggctgacaggaacggtgaccaagtagggacatttgctccagcggaaagcaccaagctcctgcacccacacccaaggagctggaggtgtgcagtaagaagggggttcacggggtgggggcttgccactgggatgaccctcaccacatattagccccaggcctagctatgtccacgctctctggcctgaggccttccagccccaagcgcctcctccctgtgcagccctgggctctggccattctgccaatgtggcctcactcattccttggcagcacctccaggctctgctcagcagcaaagggcagtctccccttcccctacagtcactcccatctgctccttgtcctcatccccacccatgagcaggacatgaacccccagagcctgccagagcatgctctgcacagtaagtaagtgtgtgtccaggcacagaacgcccaagagaaggcccagagggcggcccattcccggagagagcttcagtacctgtcctgaagctggacacggtggccccagttcaaggatttcacgtgattttgaacagcttctgccatcttcctcctgtgaagatacgaaacaaaatgtaaaatccacaacacaggtgttagctgcagggcctcacgatggactattagattcaaatggtacattcatagaaatatcaaaaaacaagagtgcttttaaaggtggcaaaacgtgacatccatccctacgtgcaaccgcctgtcccaggctcagggctgcagacctttggactcacagaaaacaggggctctgacccacggctctccagatgcagctgctctgtgccccaaaggctacccactgcaggcagaggcctatctgagccaatgtgggtgtggctgggccacgtggtccccttcccagaagagctcagctgaagcggcctcccacccgcactcctggccttggagatgcactgttcttggtggggctgtgctgtgcatggctgtagcatccctgggctccccgcaaaggggagcaaacccttccccagtgacaaccaaaactgtctccagacattcccaaatgtctgaggcagacagcgcagagtcgcccctggctgagaaacccatcctacggcccactccccatgagggctcatcgaggataagcctcctcttcctcttccacccaagagtagaagaaaagcactggaatgccacggcgccagatccttaccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgcctgggacgtgggaagagcacatttgaatttatgttcaggtgactgctggaggcttccctgttcttctagagtgtttggaattccttaaagttgctttgtaactctaacacagaccagctgacatgccacacgaatctgctctctataactgtactcgaaaataaaaacagttgtttttactttttaatatttattaatttatttatttgagatggagttttgctcttgttacccaggctggagtgcagtagtgcaatcatagctcactatagcctcgaactcctgggctcaagtgatcaaggcctgccttggcttcccaaagtgctgtgagtacaggcgtgagcaactgcacctggccagagttgttttcgataatggtcaagaactttaaagtaatgatgagtgaaacaggacactgtccagaaaccatggacagcagggctgaaggactttggtgtcagctgccctctgtacaggaactgggcccacctcccacctccttccccaggacacccggctcccatagggtgctgcctaccttggggagaaggttccacgtagtccaccacggccaccttccttcccagctgggcggctggaaggataaggagagcagcaggtgagcatggggagctggctcaggactcaagaacaggcactcctcagggcttgtgaggtccagaagagtgtgggcagggcctgggcctgcggctgcccacacagtggctgagctgcgcaatgctagggacccctgatctgcctctgcgctctggcctgctgagctgcgctgcctgctggctctgcattgagtcttccagtctctttctggcactgcccacccagctgcgctgcccacaggcaggagccctcagacctctcagggcccgcagcctttgtaccatccacccctcacagtgctggcatcagccccacctgcccctgcatgttcacgttcaccataagcccagtgcccacccaagcatccctgggtggcatcccccaggtagccactcaccgggaatggctcctgactcagaggctctcccttgccccttcccatcccagccagagccccctaggtgggcattcgctgcctcactctcaggaccaggacaccaaagctcaggagaagtgacgcagcagccccagggtggaccagccccagagcaggagccgagacctgactccaaaccacacttcccgctgcagagccacccagttgccctcccagccagcagtgtggccacccagggccacaggttctggggccaactcagaaaccattagccaggaccgggcatggtggctcacacctgttatcccagcactttgggaggctgaggaaggtgtatcacttgtggtcaggagttcaagaccagcctggccaacatggtaaaacgtgtctccactaaaaataaaaattaaaaaattggccaggtgtggtggtgcaagcctgtagccccagctacccgggaggctgaggcaagagaatcgtttgagcccaagaggcagaggctgcagtgagcagagatcacaccactgtactccagcctgggcgacagagcaagactctgtctcaaaaaagaaagaaagaaaaaaaaaaaaaaacattagctagggctaatttcaagcttccatttgcccgggcttgggcactgcatcagcaaacttcaggccttggacttgactgcctcccaaggcacacacaaatctcatgaaccctaaaatgccaaggaaagtgtttgattcgtggctattagaaagcaagattagaacaaagttttgtaagagttcatttttaaaatccattttgcttggctgggtgcagcggctcatgcctgtaatcccagcactttgggaggccaaggtgggcagatcacgagggcaggagatcgagaacatcctggctaacacggtgaaaccctgtctctactaaaaaatacaaaaacaaaattagttgggcgtggtggcaggtgcctatagtcccagttactcgggaggctgaggcgggagaacggtgtgaacccaggaagcggagcttgcagtgagccgagattgtgccactgtactccagactgggtgacagagcgagactctgtctcaaaaaaaaaaaaaaaaagctaatgtccacaaggcacagtggctcacgcctataatctcaacactttgggaggccgcagcaggcagattgcttgagcccaggagtttgagaccagcctgggcaatatagcaaaaccctgtctctacaaaaaatacaaaaattagctgggtgtggtggcatgcgcctgtggtcccagctgctcgggaggctaaggtggggggatggcttgagcttagcaggtggaggatgcagtgagtcaagattgtgccactgcactccagcctaggtgacagagcaagaccctgtctcaaaaaaaaaaaaaaaaaaagccagtgtgccagtgtgtaactcccacatctgaccacgatggagcagcagggcccagatttaccctccccctgaagcaacccaaaacccaggtaaaatgcatgaaacaacgggctttcaggtactccatgtcaggtaacaaaggacctgagagagaggaaacaaacatggtgagccctggggagtctccaggacccagcactgcaggctggggaagatggggagaatccagcacaggagagggctgagaactgggggagactgaggcagccagaggtcatgcacagaagacagtgaggagggggctgcccagagaatctgagagatctgatcggcgcatgtgtcttgggaaactacctgagaccagacagaaccacctggaaggactggaggggacagagcccacacagggcaggggacagtgcctgttcccagaatctggactgggaaaagcatataattcctggggcgttgggtcatgccccagtagttgagaatcattagccctagactgggcactgctccatacccacctaacaaatcttttgcagaagacccaaaaggatcaaactgactcttaataactgcatcccagaacagagctcaataatagtatttctagaaatacaaaaatgcccagaacccaacaaggtaaattcaagtgtctggcattcaaccaaaaattaccagtcacacaaagaagcaggaaaatacacctataaaggggacaaaaaaaaatcagtcaatggagactgacttggaacagacacagatgtcagaattagcagaaaagatcaataaaacaggtattctaactattccatacttttttatttttatttccttgcttagatgcctcacttgtgtgccctaactccaccttatcacatatgatgaactatctgttcatgtgtctgtctcggtaactaaactgcagaactccgtcagtcaggggctttggtcctggtttgtctttgttgttccgggtcctggcccagagcttggaccacattaagtattcaaatggtttgttgaagaaattaacatgttaaaaacaaacctttctcacagaacactgttcctccttcagtgttcaagatcccagacctttgggtccctttttacctacttactccctaccaaaagttctctctccttcgactccagggtggttttataaacctcttatgcatctcaacttgcactatatggtagctacttttcacagctacagacttttggtgtgggaaggatctttttttctctttttttgagatggagtctagctctgtcacccaggctggagtgcagtggcgtgatcttggctcactgcaacctccacctcctgggttcaagcgattctcctgcctaagcctcctgaatagctgggattacaggtgcgcaccaccatgcccggccaatttttttgtatttttagtagagatggggtttcaccatgttggtcaggctggtcttaaactcctgatctcatgatccgcccacctcggcctcccaaagtgctgggattacaggcgtgagccaccatgcccggccaggaaggatattatatgcaatttgttctacctgcttacctgaagtttgagtctccttcataacatcctcaccaagtgttcacctatgcctggtgcctttgtctgggaatgtattgccttcccaagtggccatttaattttgggaactctcccaatataaaatttctcctcatattaattggaaatgttttcctataactcttaactatctccaccccctctcccacatgcccactctttaaaatttaaaactatttttttcctttcccttaagttttctctttttgaattccttcaatgatgactttcaaggatagattccttcaactaggatagtttaggtcacttctctccaaatgacccaccttctccaaacctctgttcagaaggggctgcgatgctcccagtaggaagtctgaggccctaaaaatgggcagctctcgacctgtcctggctctgggctgtatcagccttgaactcggtcacatcaaacatctgacttatagaagttaacaagcagactgggcgtggtaactgacgcctgtaatcccagcattttgggaggccgaggcgggcagatcacctgaggtcaggagttcgagaccagcctgaccaactgtagtttcacgaccagtagtgaaagctcgtctctactaaaaatacaaaattagccaggtgtggtggtgggcgcctgtaatcccagctactcgggaggctgaggcagaagaactgcttgaacccgggaggcagaggttgcagtgagccgagatggcaccactgcactcaagcctgggcaacaagagtgaaactatgtctcaaaaaaaaaagttaacacagcattcactgaaacccctgaggcttttttttttttttttttttttcaaatcttgtggacttctgactggtacaactgcagctgccttgcctggtaacttgggtacctggtttgtgggtccaactgcaggccattcaggtagacttgattttttttttaatttaaaaaaaggcttttttttcttttttcttttaaagagacagagtctcactttgttgcccaggcactggtgtgcagcggtgcgatcacagcttgcttacgccttgacctcctgggctcaagcaatcctcccagctcagcctcccaaagtgctgggaccacaggcacacaccaacgcccagccctcagtggttttgatggattagtgtatccccagaccctccgaaggggaggacagtgccttatctctctctttcttccaccaagaaggccacaaccggccttttaaccttgatccaagcgaggctgaaaagcaaacagggcgttcatcttcatcctttatagccacatagccacatctcccgcccacaagcagattccaccaccccccgcaccctaaggcccagcctcatcagctgcagcatcttcacctggcctttcacactgaagcagaaggggtgacggtttactttcagctgcatggtctccatcatacccgtagacccaacagctgagcttcccctctgtcccttctcctcagctcactgccccactagccattctgcatgttcaaacagtgcaggagcaacatggaagatataaccaaaggctcaagctggattgtagagatgaaaactacaatacaggagatgaaaaatacactggacgggattaatggcaggtcagatgttgcagaatcttttattggtgggtttgaaaacataggaatagaaactatccaaaatgaaacgcagagtaagaaatgtttctaatgaaaagagcatcagtaggttgtggggaagcttcatgcagcctaatatacatggaattaaaagtccccacatgtgaggggaagaaggagggactcaaggccaatgaaaagagaaaatcctaaaagcaaccaagacacactacagagacactaagataaaaatagtagcagatttctcactggaaacaatgcaagccagaagtcagaggggcaaaatttttaaagtactgaaaaaaaaaaaaaaagcggggggccaggcatggtggctcacgcctgtaatcccagcactttgggaggccaaggggggcggatcacaaggtcaggagatcgagaccatcctggctaacacggcgaagccccgtttctactaaaatcacaaaaaattagacgggcatggtggcatgcgcctgtagtcccagctactcaggaggctgaggcaggagaatggcgcaaacccgggaggcagagcttgcagtgagctgagatcgcaccactgcactccagcctgggcgacagagcaagactccatctcaaaaaacaaaacaaaacaaaacaacaacaacaaaaaagaaggcaaaataaagacgttttcagacatacaaaagctgagagaattcattacccccagagccatattacaagaaatgctaaaggatgcccttaaggtagaagaaaaataccagatggaaatgtggatcctcacaaaggaatgaagagcacagaaatacaatgggtgagtatgtgagattttctcacacgatttaagtatattttaaacaaaaataataatgatgtatcatggatttataacatgtaacagtaaacacatgatataataacatagaatgaaggttaggaggggtggaatagatgtatgcttttttaagggtagactggcaagttaaggtacatgccataaaccctaaagcaactcaaaataaatcaaagacctaactgtaagagcttgaactataaaatgcttagaagaaaacacaggtgtaaatctttgtgatcttggatttcttagctatgataccaaaatcataagcaacaaaggaaaaaaatagataaattaggacttcaccaaaatttaaaacttttgtggcacaaaggataccatcaagaaagtgcagggccgggcatggtggctcacgcctgtaatcccagcactttgggaggccgaggcgggtggatcacctgaggtcaggagttcaagaccagcctcaacatggagaaaccctttctctactaaaaatacaaaattagccaggcgtggtggtgcatgcctgtaatcccagctactcaggaggctgaggcaggagaattgcttgaacctgggaggcggaggttgcggtgagccgagattgtgccatggtactccagcctgggcaacaagagcgaaactccgtctcaaaaaaaaaaaaaaagaaagaaaaagaaaaagaaaatgcgaagaggccaggcacggtggctcatgcctgtaataccggcactctgggaggccgaggtgggcggatcacctgaggtcaagagttcaagaccagcctggccaacatggtgaaaccccatctctactaaaagtacaaaaattagtcgggtatagtggtgtgtgcctgtggtcccagctacttgggaggctgaggcaggagaatcatttgagcccaggaggcacaggttgcagtgagccaagatcacaccactgcactccagtcagggtgacagagcgagactccatctcaaaaaacaaaacaacggcggctcacacctgttaatcccaaccctttgggaggccaaggtgggtggaacacttgagaggtcaagagttcaagaccagcctggccagtatggtgaaaccccgtctctactaaaaatacaaaaaattagctggatgtggtggtgcacacctgtaatcccagctactcgggaggctgaggtgggagaattgcttgagcccgagaggccgaggttgcagtgagccgagatggtgccactgcaccccagcctgggcaacagagtcagaccctgtctgaaaacaaacaaccaaccaaccaaaaaacagctgaaatgtccagaacagacacatccacggatataggaagtagattagtggttgccaggggctggggagaggggggaagagactgactgccaatgggtacagggtattttggggagaaactaaaatgttcttgaataacacaggtttgaactgcacaggtccactcatacatggattttttttcaataaatataatcccttgaccgggcacagtggctcccacctgtaatcccaacactttggaaggccaaggtgggcggatcacctgaggtcaggagttcgagaccagcctggccaacatggtgaaaccccgtctctactaaaaatacaaaaattagctgggcgtggtggcaggcacctgtaatcccagctactcgggaggctgaggcaagagaactgcttgaatccaggaggtggagagtgcagtgagctgagattgtgccattgcactccagcctgggtgacaagagcgaaactcggtctcaaaaaaatatatatattatctctccatatcagcaagttccaaatctgtaaccaaactcggattggaaatacagtactccactggacatggtggctcatgcctgtaatccagcactttgggaggctgaggcagacggatcacttgagctcaggaattcaacaccagcctgggcaacatagcgaaacccaccttctccaccaaaaaaatacaaaaagtagctgggcatggtggcgcctgtggtcccagccactcgggaggctgaggtgggaaaatcgcttgaacccgggaggtggaggttgcagtgagccgagattgcaccatttactgcagcctgggcaacacatgagaccttgtctcaaaaaaaaaaaaaaaaaaaagaaaagaaagaaagaaagaaaagaaagaaaaagaaaaaaacagtattcataggatgcaaaactatatatacagagggctgactctgtatctgtgggtgcttcagggccaactgcctgactccagtatgcacaaatttcagtgtccatggattctgctaacagcgggagttcctgaacccagtcgtcctcgggtaccaagggacaaatgcatacgtaatgtgaggtatatctcaataaaactattctaaaaatatgaaacacttagggatgtatctgataaaatatgtgaaagacgtagacattgaaaaccacaggccaggcaccgtggctcattcctgtaatcccaacgttttgggaggccaaggtgggaggatcatttgagcccaggattttgagaccagcctgggcaacacagagagaccctcatctttcttttttttaataaaaaaaaaaaacttgagtaaaaaagaaactacaaaatgctgctaaaagaaatgaaaaaatacctaaataagagatataccacacgatccagttggtccatttttaggcacttacccaaaataatttaaaacatatatccacacaaacacacagacagacgttcacagcaatactgtccacaatggccaaaaggtggaaacaattcaagtgtccagctacaggggaacacgtacacgaaacggcacagccataaacagaacactactcagcaatgaaaagcaagaaaccatcgacactcgcgccaacgaagatgagtctcaaggtcattaccctgagtgaaagaagccagaagaggaagatgacatacagcagcattccgtttatacgcaattatagaaaatgcaaactatagtgacagacagcacatgcctggttgcctaggatgcagaagtgggggaagccggaaggaactgccaaggtttcagaaaatgttggggtgttatgggctgagccatatcccctcaaaatccctatgtggaagccctaaaccctagcacttcagaatgtgactgtatttagagatagggtcttcaaaaaggtaattaagttggctggacacggtgactcatgcctgtaatcccagaactttgggaggccgaggcaggcggatcccttgaggccagaagttcgagaccagcttgacaaacatggtgaaaccccgtctctactaaaatacaaaaattagccaggtgtggtggcaggcgcctgtaatcctagctactcaggaggctgtggcaggagaatcgcttgaacccagaaggcacaggttgcagtgagccaagatctcaccactgcactccagcctgggtgacaaagcaagactcgcttgcaaaaaaaaaaaagaggtagttaagttaaaatgaggccataggccgggcgcggtggctcacgcctgtaatcccagcactttgggaggccgaggtgggtggatcatgaggtcaggagattgagaccatcctggttaacacagtgaaaccccgtctctactaaaaataaaaaaaattagccgggcgtggtggtgggcgcctgtagtcccagctactcgggaggctgagacaggagaatggcgtgaacccgggaggcagaggttgcagtgagctgagatcacaccactgcactccagcctgggcaacagagcgagactccatctcaaaaaaaaaaaaaaaaaaattaggccatatacaggtacagtggccacacttgtaatagcattttgggaggctaaggcaggaggatggcttgaacccaggagtttgaggttgcagtgagctgagatcacgccactgcactccagcctgggaggcagaacaagaccctgtctccaataaaaagccaacaaaataagagggcatccacctgatccattaggacaggtacaggtagagattaggacatagacatgcacagagggacgacaactgccatctacagcccaacggagaggcctcagaagaaatcagccctgcccgcacctggatgatttctagcctccagaactgagagacaataagcatgtgttgtttcagccgcccagtctgttatggcagtctgtttattacggcagccctggcagactaacggggtggaggacacactcgccaatcttgactgcggtactggctgcatggacacatgcacacataagaatgatcaggttgcccattttgataggtacagttcatctcaaaaaagccacaaaaccacgtcatcctctgcagggaaatgccactctcatgaaaggcggagacatacccaggagctgtccacattccggattaaaggggactcaggtctctgcagctggtcactcccagcatgggagtgaacgcacagcccaggtgcccggtctgctaaaaggaacagcactaggcctcgtggctgcctgcgccatcgtttctgggagtggttctgagagtacagtgtggcactgatcctgggtgcctctgcggatccccaataggccaggagacttcccaggttcctacacactccccggcccccacagagcaagagtagtggatttcttttacaccatgtatgcttctagagcccaatactggacatcagagaagcacagcttcagggccaaagtgcccagttaactccctctcatttcagccccacctccctctcatccccttccctccccattcaccacaactgccctcttatcattgtgtagacatggccagagcagaccaggaactcctacagcagggcacagagtctggcaaagtgctggtggcctgtgcatcacgtgggttagcagagaactgcaaagtgtcatctctggacacctctgggtccagcccgttcgcccaacatctttactcaatgggtgccaggccaagtacaagactcacccagcagaactgaccatggaccctgggggaaggcaccagcactaagaacaaggacagggacaagcaggagggtgcagctccagcctcgcagctagccgggcaggggcagagagcaggcaggcagggtgacagccacagtaaggtgaaggagaggactgtccagaagcacgtgaaggaaagtggggagcccacggagggtgtgagtggtgggagctgagactagtcggattggggctgtcactgtgagtaaagcagaagagctggagggctggagctgaggaaggcagttcagccatgaagtgccacggcggccgctgggtacagcagacagctggagagtggcagggaacaagccacaacacagaggccactggggtgaccccagcagggaggcaacgcattttgctcatggacgttttctggacagcaccaccctctctaggggccctaaaagcttcgaggccttgccacgaagtatacagaatacataccctccttggcacaagccaggccaccagatcccccgccgaccaccaggagatcatagtcccgctgacctgctgagagaagggatgagaggtgggacggactgtctgtctggttaaacgtggtacaggatcaattttatcaggattggacactccattctgtgatggtcaggggtgacaagacaccacacaacagagcagaaagagtgactcgatacacatagtctgtgcaaatccagagaccaagccatatggtggtgaggttggccgtgggcgtgtgtgatcatctttgcaaatcacacgcacaccataccaaccactctgaactcaaacctcacccagtgttctcagccagacacagaactaagatattttcttttttattctatttatttttgagacaggatctcactctgtcacccagaagattgtagtccactgccctgcttgggggagggatgaaaggtgagaaggaacacggtcagcacagggctgggacatagacccggaagggcccccacgacaggggcacagtggcacaatcacagctcactgcagcctctacctcttgggctcaagtgatcctctagcctcagcctccagaatagctgggactacaagcaccgatcaccacgtccagctaaatttttttgttttgtagagatggggtctggctatgttgcccaggctggtctcaaacacctggcctcaagcaatccttccaccttggcctcccaaggtgctagaattacaagcatgagccaccaaggtggactaaaacattctcaagtccacgtgcctttcagttgtgaaggctgccctccgtcacaagtgagcaagaataaaagcacaggctaggggcggtagctcacgcctgtaatcccagcacttttggaggccaaggcgggtggatcacaaggttaggagatcgagaccatcctggctaacacagtgaaaccccgtctctactaaaaatacaaaaaaattagccgggcatggtggtgggcgcctgtagtcccagctactcgggaggctgaggcaggagaatggcgtgaacccgggaggcggagcttgcagtgagcggataccacgccactgcactccagcctgggagacagagtgagactccgtctcaaaaaaaaaaaaaaaaaaaagaataaaagcacaagcagcccctgtccctcacagctggccagtgcacacagccagggtcttggtgtgcccagctgcagtcagctaggagggaagccaccctgggcacagggagagctgcctgggctcaggtttcatccctggaattccttttgggctggttgtggtgtcgcctcaccttggtcctccatggtggctcactgcacatagtgccactctcagcctttttagcctgcaaaaggtgtcatcgtgtctactctgcaagctactggcgaggaaggcaggcaaggggcagccaaaaaagggagggatggagaagggactggagggaggaagtagagaggggaagtacactgaactgggcctgaggtccgggacacccagcaccaggcaccagccaactccctgctgaaggaaggaagaaataatagcaagtcatcagtctgctggggtgagggcagggtggggactgatgacaagactctagggtataaaacaagtagtgccctcagcccctctgcagacacgagcctgcccagatgagaagcaccaccctcccagagcatctggagccggtcgctgcttcagacaaggccaagaggttccatgatcagagcagggtctgtcatacaaggctgggcaacctgcccaacacctccatcagagcctagcgtctgccatgagaaggctgcacttatctttgcagccacctccaccttcctaggcaggcaaggctgcagagagtgtacttggagtgtcatgtctctccacaccctggccctgcagatgccccacagacaggtctagaacatgcactcctaaaggatacaagagctggagcctagaggagccctggctcacagctgagaaagcttgggaagctgcatccaggcactcaggccatggcctgcagcgagcctgccccacaaccaaacccacccactctttcacctggcagccagcctctgagtgcacgtgagatgtgtgcgcacctgcgggaactgacagagccacaactcggttccaacagccagtccaaagcacactcaattcctaattcaactcaagggctctggaaaggcctaaattgttgtaaattattctaatggctttaatataagtctagagaaccaaggactgctggtcagggagaaaatgccaccaggtcccccggggagcatgaacctgctgatggagaagcatctctctcctccagctgcctggtagccggaagctttgctcagaacgtccctaccttccatggcaggtgcctgtccttcttgttgccatagcagggcccttgttaggtcatcctgccctgcagcctcgcactgtgccccctctgtctgctatcaggcagggtgagcagctgtctgtatggatgtgcttatcttgggcagcttgctcgccccctgtgcacacccaggagccctctcgggctgataaacactggcatagggcagtcgtttgcaagcataggaaatctgcctttaagcacttggaagggcttgggtagcctgctgggaaggaaggaccccaaagtacctcaaaggtgggtagggcagatgctgttctgtgggaggaagggctgggtggcaggcgttacctggggacacaccacctgtgcactccagtgtcctggagaacctcataaccttgcctttcacccactttagccaggcataccctctccacctgcagggcttggccccagcaagtgtctgtcttgcctctgccttctgacatattgtccattaattttctgctcctctttgaacccactgcctggtacaggccagcaaagagcaggagcccagagctcatagcaaggcccaagagaatgcagcactgcaccagtgagggcaagtggaagggtcccccaaaatgtgcacccacaggcaggctggccacctcagggtgccacctcaggggccctcctgtatggctgctctatctagagctctttcctggcagcaggtgttgtcattctggctcctgttcaggggctgcatcgcccacccactccaagcctgggacagttcaggtcttcctactctaaaaggagaaactgcagggcccacagtcccagctactagggaggctgaggctggagggtgagttgaacccaggagttcaaggctgcagtgagctatgatagcaccactgcactccagcctggttaacagagtgagactctgtctcagaaaaaaaaaaaaaaaaaaactgcacccctagtctgggtacagtggctcacacctgtgttgcaggaagtcaggaaccccgaatggagggactggctggagccgtggcagaggaacataaatagtgaagatttcatttcaatatgaacatttatcaattcccaagtaatacttttatacttttttcttttttttttttttgaggcagattctctctctgtcgcccaggctggggtgcagtggcacaatctcagctcactgcaagctccgcctcctgggttcacaccattctcctgtctcagcctcctgagtagctgggactacaggcacccgccaccacacctggctaattttttgtactttcaggagagacagggtttcaccatgttagccaggatggtcttgatctcctcaccttgtgatatggctgcctcggcctctcaaagtgctaggattacaggcatgagccaccgcgcctgggcccccaagtaatacttttataatttcttatgcctgtctttatctcttaatcctgttatcttcataagctgataatatacatcacctcaggaccactgtgataattgtgttaactgtagaaattgattgtaaaacgtgtgtttgaacaatatgaaatcagcgcaccttgaaaaagaacagaataacagtgatttttagggaacgaagacaaccataaggtctgactgcctgtggggtcaggcaaaaagagccatatttttcttcttgcagagagcttataaatggacgtgcaagtaggagagatatcgctaaattcttttcctagcaaggaatattactattaagaccctggaaaaggaatgcattcctggggggaggtctgtaaacggccactctgggagtgtctgtcttatgcggttgagataaggactgaaatacgccctggtctcctgcagtaccctcaggcttattagggtggggaaaaaactccgtcctggtaaatttgtggtcagactggttctctgctcttaaaccatgttttccgttgtttaagatgtttatcaagacaatatgtgcacagctgaacatagacccttatcaggagttctgattttgcccttgtcctgtttcctcagaagcatgtgatctttgctctgccttttgccctttgaagcatgtgatctttgtgacctactccctattggcacaacccctccccttttaaaatccttaataaaaacttgctggttttgcggctcaggtgggcatcatggtcctaccgatacgtgatgtcacccccagcagcccagctgtaaaattcctctttgtactctttctcttcatttctcagccggctgacacttacagaaaatagaaagaacgtacgttgaaatattaggggcaggttcccccaatatctggcgcccaacgtggttttctttttcctaagtgcatgtgggaacccgattccctttggtaggtgcggagaaatgttcatcggtccagtccacagaaatgcttgtttggctccccaacgattggtgagttgtctgtgtattctccggggtaactatgggtcacgcagagtctaaacattatgcttatctctgctatattaaattcctgttaaaatgggggagttcgggttcccatggaaaatatggtcaccctattcagggcagtggaagaacactgtccttggtttcctgaaaagggaacgttagatgtggaactatgggatcatgttggtgcaaaattccgagaactggtcccaacaggaaattatgttcctgtcactgtttggggtgattgggccttggtacgtgccatcctaatgacataccaatcccgtgacaccctgcagttaccacagttttctgaatctggccaccctctacctcttcctcagctttcctctcccactcggccttcattatctgctcagcccctccctttgcctactcctcccccacctgacgatactgaggattcaatatctaactccagtgactttggcttaacatcaccccctgatgatcttatttcttttcacgaagagccgacacttgtagctcctgcggccccaactcagacagcccaggaccatatctatgctaactcttccctctccaaacctttacagtctttgcctccggagccatccaaactacaatttacctgtaattctgcaggccctcccccatccaccacagcccctcaccctcctatcattttggtccctcaaccggtcactttgccatccactcaacctgcttctctgtacccttcttcatgcagggacacccctgccactctggttgtgcaggactgggccagtaatcaccagtatgcttctgcctcttctgctcccccaatgcccctttctcacactcttataccagtccgaccccgtcaatctcagtttctcttatctatacatacttttcctgtcacttctatgccgactctatctcatgtgcctgctcttgaaactttcatgcaatgcttattacgccaaaacaaacaagtagattagaggcgtgggcttattcggtcatgctggaacctcctaatgctcaaggggtacaagtgtgtcgatatacgccgctcaatcttacctttttaaaagaattcaaggatgcttgtactcagtatgttcctacttctccatatgttaaaacggtattacagactctttgtaccgaggtcattttgcttcctatagactgcgaccttttggcaaaagctgttctaactccatctcagcatttacaattccatacctggtggtcagaggaggcccgcctgcaggctcagctaaatcgggctgatggcattccaattactcaggctcagctcacaggctccgataattactctgatactactgctcatttaggctttgatgctctcaccacggaacaagtaacaaaggtgtgtatgagagcttgggataaattacgcaccccaggccaagcttctgtttcttttactattgttaaacagggtcacaatgaattatatcttgattttttagctaaattacaagatgctgttgaaaaatctgtctctgatgagcacactcaaggtattcttcttcatatgttagcttttcaaaatgcgaaccatgagtgtaaaatggccgtgcattccatcctacgtcaaaatttacctgatcatgaggtgttgcctgcatatattaaagcttgtgaaggcgttggatcggagacccacagagctattctgtgggcaccggccatgaagcacggcaaccaaactggctcgactgattcttttcttggagcctgctataattgtggccaacttggtcatacccaaaaaaactacactgttaaaaacttaaaagcggccaagccggctcaacaaacacggccaaatgctcctgctactgtttgcctgcgttgtcgtaagggtaaacattgggcaagtacttgccactcagtctgatatagatgaaaatcccttgccacagaaccagggaaacaggaagcaaggccagtcccaggccccaatatcaaatgggacacctcggactcagaccaatgttgtgtttttgcgtcaagcagtcccaacgcagcccccagcacaaacaaatttacctacagccaatccagatgggtcccagcctcttcttctgtctcagtacaatgcttgtctacctccacagtaggcagcagggcggtcgatctctgtagtaccattcctctaaatttactacctaattctttgcctttaattgtccccatgggggtcactggccctttacctcaaggttcggtgggcctggtgttaggcagggcatccacctcatgatactaaaggtatcatagttcatactagtctcattaattctgattcctctgatgagattaaacttatgtaaacttatggtgtctgccaaagttcctgtttccattccggccagtgagtcaattgctcaattacttttactacctaacattgttttaaacaaaggagataagacatggggccctgggatgggctccagcggtgaaaaagccgcttattggattaatgtaatttctaaacaatggcctacctgcaccatacacattcaaggaaaaaaggttgagggcctagttgatactggggctgatgtttctattatttcctctaatttatggccttcctcctggcttaaacatcccactaacatgaaactagaaggtgttagaaaagctgaagaagttcaccagagcacatttatcttggcttgcactggccctgatggtcaaaagggaacaattcagccttatatcatgcccatccccattaatcttcggggcagagatttgctggcacaaattggggctgaaattaatattccacataacttttacagtgctcccagtcaacatataatggaaaacatggggtttgtttccagactcggtctcggtccaaaacgtgaaaaaattactaaacctcttcaagttactgtaaaagaagacaaggctggtttaaaagcataatttaactactccccactcccaattatatttagcattgtttaagctttctaaatgttcctaaaaacaatactctgactgcagctaaatgccattatacaggcaaaaaattctccctaaacgaaggcaagccagtgtcatggaaaaactcccaaaccaatacctgggaacctggaacaattataacgtggggaagagggtatgcttgtgttttaccaggagatcgtcaatcccgtctgggtgcccactaggagacttaaacttcgtgtgaatactgacaataaaaaccacgaggaagagacgttcgcgtcagagactgccctcatacctgatgagatctgtaccgactcctcagaaactggcatgccaaatcaaaatgggtctggttcaatcctccctaatggcaatgtaaacccctctaactaatcccacttctcctaattatctttttctccttacgaacctaaaaatctcaccatttctattagcctgaaaataacatccctctgttcttctcttcctccttcagcactggatctcacttacaataggttttatttaataattatcttccttacactttctgtctcaccagtttccccttaaactgatttacctgctacacaaaattattcttattgggcttatgtgccttttcctccacttattcgacctctcacctggatggatgctcctgcagaaatctatactaacgatagtgtgtggatgcctggaactacagatgaccgttgcaccgctcagccaggagaaggcactgcatttaatgttactatgggttataaataccctcctctgtgccttggacatgcacctggttgtatccatctagaagctcaagtctgggctgcttgtcttccagagagattagctatagggaaatggggacatttggtctctggcctctccctttctcctttaagacaaataaaaagaggagtaataggagataccccatactttcaatataaacctgtaggaaaaccatatcctaaaaattttgagggcccatctaaaacttcaatttgggaatgattgtgttaactcacatgcagtagtattaaaaaatgactcggctgggcgcagtggctcatgcctgtaatcccagcactttgggaggccaaggcaggtggatcatgaggtcaggagattgagaccatcctggctaatacagtgaaatcccgtctctactaaaaatacaaaaaaaattagccaggcgtggtggcagatgcctgtagtcccagctactcgggaggctgaggcaggagaatggcgtgaacccgggaggcggagcttgcagtgagctgagatcgcaccactgtactccagcttgggcgacagagcaagacactgtctcaaaaaaaaaaaaaaaaaaaaaaccccaaaaaaacaactcatatggtttagtaacagactgggcacgaaagggctatttaaaaaacagttgctcctctggcggaaaggaatgcctggagactacttattttatttcttactgggaggaccaggatcatcatcctattttgcatagaaggttcagtttgttctttcccttaaaataggaagataagggcattatccccctaagtctcgtatgatattccccattctgagtccagaatacctagaaatttggaatttggctattgccgtgtctggactgtgagtatgggaaggggaagcttttctgtctgttgtccccactaccgcccctcacatccgtgattctgaaccccatgataaatgccctttgaacctttttcctccttttgatgccgaatccccttttatgggactccgccagcacgggtgcatttaaccttcctgagcttgcccacctgacgcatgcagccaagaagctttgaaagatggagtgccctggctgagggttccaggtctcagcaaggccacgaggtggtgactgcctcccagaactctgttgggccaccctccgtcctggagacccccaaaacctccatagcaccaactctgcccattcacacacacagtcagccctccctcccgagtccaccgcgggcagagggccagccaccatgcctcccatagccgccatccctgggaaggagccctgaccccgtccttacacccctctacactcactgcctgtggggagagctgctcgctgtcacaagcatccagggggctgggtcgaggggccccctgcatggtgggggaccatgttgtcgtgcatggaatgaaactggccacacataacagatatggtggcgctctggtcggatctaggggagtctgtcctacaggatgaggcttgaactgtcctgagtgaccagacacccagcctctgcttcgagtgctcagttatgattattgtcctgatttagttaactgttcttcaggggctccaggaggacgagtgtgtatcctcccattgctctgtgcagcctctaacctctagagtctaggggtctggggagaagttgggaagtctggccagtggggccggtgcctggtgacctcgggaggtgggatatcatcatcttcagaactgtagttgttactgggataccagctctgggagaccacaggtgcagtcagcacagcaggaccttagacaaggcacccagccccagtttccccacctgggaagggggctacttgtggctagaagcagcccggactcctgagcaagactagaccaagaggccggtatgtggacacccccgcgtgggcacccccacggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctacttgggaggctgaggtgaaaagatcgtttgagcctgggaggcggaggctgccatgagccatgatcttgcctctatactccagcctgagcaacagagagcccctatctttaaaaaaaaaaaataataataaaataaaaaaataaaaagaaagaaagaaataaaaacaaagatgaatggagctgttgataaacccagtttttgagcctacagggcagcagttgaggtttctggccgttgggccctaacaaggccagcaggggcactcagggacttcctggtgtgtggtgtgaagtctgtgatgatggcataggcattggtatcccagttgtggttactttctggagagagcatgtggcatgcaggagctggagggggggtcttcctgggcggcctgtgtagcagcagctccaggcacaaaggctgcccctggagaatctgttgtggttctgagttctttcaagtttatatcaagttttccggcttcagtctgcagggctgtttttttcagatcctgggggcaaagggcagctacaagaccacctgagtcccaatagggatttgagttcttggtgacaccaagtcagggaggagacaaattagaaatgtcagtctgaagagagtggtaggtagccagatactgaaggaaagtagatgggaggatttggtaagggctgacgtgtaggaaggcagtgacagtccaagtgacaggcagatcataaaacctcaaggataggccgggcccggtggctcatgcctgtaatcccaagcacttcgggaggccgaggtgggcaaatcacccgagtccagaagttcgagaccagcctggctaacatggcaaaaccctgtctctactaaaaatacaaaacattagccgggcgtggtggtgcactcaggaggctgaggcgggataatcgcttgaactgggaggtggggggctgcagtaagccgagatcgcaccactgcactccagcctgggcaacaagagcgaaactccatctcaaaaaagaattaggccgggagcggtggctcacgcctgtaatcccagcactttgggaggccgaggcgggtggatcacgaggtcaggagatcgagaccatcctggctaacacggtgaaaccccatctctactaaaaatacaaaattagccaggcgtggtggcgggcacctgtagtcccagctacttgggaggctgaggcaggagaatggtgtgaacccgggaggtggagcttgcaatgagccgagatcacaccactgcactccagcctgggcgacacagcaagactgcgtctcaaaaacaaaacaaaacaaaacaaaacacctacaaaagacagtgaactagactaggatctgataactcccaagggggtgttatatttctccactgaagcatagcatttctctttacaaacccttcccttttgattgaagataatcaaagtgagattattcttatttaccaaataattctggtctcattaaatttggcctgattatttacataaatgcagcacgaacagtaattgaccacacaggcctttttaagtttgctgaaacttttaatagggaatcttagattgagctttttaaagccttt[450 bp omitted]aaagataattgcttcaattttgtttagagaagtatcatttactataatattacgagtcattgataggttaagagaaaagggaaaggtttctttctttttttcttttttgaggcagagtctcactctgttccccaggctggagtgcagtggcgtgatctcagctcactgcaagctccgcctcctgggtttacaccattctcctgcctcagcctcccgagtagctgggactacaggtgcctgccaccacgcccggctaattttttgtgtttttagtagagatggggtttcactgtgttagcaaggatggtctcgctctccagacctcgtgatccacccgcctcggcctcccaaagtactgggattacaggcgtgagccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaacgtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccaagatcacgccactgcactccagcctgggcaacacagtgagactccatctcaaaaaaagaaataaagaaatgctgtcagaagcctaccccatggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatgacacatagcattttaaataataaccagaatgatgattgctgttatatgaggacatgtcattggcagaagggtattcaccagtttgtgggaactttatacaatatctggaatccttatattaacatttaccaatatgcatgtaactcaaggaagtttaaatagcattaaaaaaaatttttttttagtttttttttttttttttttttttgagacagagtcccactgtgttgctcaggctggagtgcagtggcacgatctcggctcactgcaacctccgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaataaagacacaagacaaagagatagaagaaaagacagctgggcccggggaccactaccaccaagatgcggagaccagtagtggccccgaatgccaggctgcgctgttatttattggatacaagacaagggggcagggtaaggagtgtgagctatctccagtgacaggtaaggtcacatgggtcacgtgtccactggacgggggcccttccctgtttggcagccgaggcggacagcgagaggagacagcttatgtcattatttctgtatttcagagacctttagtactttcactaattttgttactgctagttagaaggcatagccaggtacagggtggaacatgaaagcggaccaggagcgtgactgcttaagcacagcatcacagggagacggttaggcctccggataactgtgggcaaacctgacactccacaagaggtggttgagcagagtcttctctaactcccacagggaaagggagacttcctttcccggtctgctaagtaacgggtgctttttctaggcactgacgcaactgctagaccaaggtccgctaagtaacaggcgtcttcccaggcgctgacgttaccactagaccaaggagccctctagtggccctgtccgggcataacagaaggctcacacgcttgtcttctggtcacttctcaccgtgtcccttcagctcttatcactgtatggcctggtttctcctaggttataattgtagagcgaagattattataatattggaataaagagtaattgctacaaactaatgattaacaatattcatatataatcatatctatgatctatatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggactccttgagcccaggagtttgagaccagcctgagaaacatgctgaggccctgtctctacaaaacaaaaagttgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccacctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctgggtaacagagcgagactctgtctcaaaaaaaaaaaaaaaaaaaaaaaaatttaaagaaactttatacataaatccattcaatgattatgaggtcaattctagccagctttgacctcataacataaaatttcttttctgcagactttcttgaggccaggagttcaagaccagcctgggaaacatagggataactttctgtatccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgtttcagcactttcttctcttcaggtattatttagatattcaatgaatgtctattatttaacttcacttagtatgactctgaggttgaaagttactgaaaacatcttgtaagcttttttaggccaatatattatcaaacgcaattaacaaaacacaactcactagtttatataagagctagttctcacttttttttttactctattttatatattttttcttttcttttcttttcttttttttttttttttttttttctgtagagacaaggtcttgctgtgttgcccaggctggtcttgaactcctagcctcaagtgatccacttaccttggcctcccaaagtgctgggattacaggtgtgagccaccacccagccctattttatatttttatctgaactgtgtttctggcaaattggacaagttaagggtcacttgctccatgtgaggggaaggctttctacctgtatttgtggataagacctttacgacttgttttgccctgatggatgactacatgtttccagtgagctcagctggttgcttttgtgggtccctgaggcactgcgagcccctgatggggcaggaagcctaaagttccagggaccgtggggagttgaggggctggagggggaagagagaggcctgcagcggggatccacaggtggaggaggccagacttgaagggggtgtctccttcaagagaaagtagggaagtatggaggtgataggaagggagaggcctgagaggagctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccccagccagcatgggctggagaaaggctctctactgcacaggggcctcacgtgactgcagggctctggggaggtggggcacctgtagcctgacccccaccttgctgcttccaaagcttccttgcccagggctgggccttgtggggcaccccccacaccgtggtctgcctgcctgcagggtgcccagggagaccctccgcctttagaagtccaagttctttcccagccccctccctgcctagctgcctgcccctggcgccagacctggcccgcaccactggggcactgtgttcccaggggcaccctcctatcccaccagccccaaagcccagccaggcacccttccctgccacctccctgggccctgccccagcagcccagtcggcctcctcgggccttctgtcactcgctcacacacagcaccatgtcagtaaacagctaactcaggcctagggagttaggtaggatggggggagtggggtgggggggcaggagggtgtccccaaagtcaggcttggctggggcgaggcgctgccaacccctgccgccagggggctccaagctccacggcacgatctgctcagggtggcccttcttccacgatccaagccctaagaacaagaggctgggcctgggccctgcagagggaaaggggatggtggacgctgcagccactgagtggcacaggaccacgtgtaacctcagggcagggcagccaactccacaggctacatggatggagatgtggatagaagcatctgccctgggtggtgtgggctgaccccaagggtcttggcaccagggctgatcctgacttgctggtccccgaagggcgttggagggtatggtgcccatccctactctggtcccatttcctcaggcccctgatcccacagtgcctgggacagggctgtgggcccagggagcaccctccctctctgacctctgcctggtctttccgggaatgggccactgggctgctggactggaggccaaagtcctgcggggaacgtgcgggaagagcagagcgtgcaggcagcggagactaacaagaagccctggcccagagggcaggaacaggtggacgaacaaccagatgagagaacgtaccaggcatgcaagctagacccaggaatcaacgggctgaggcttagcgtcccctacggcgtccaccagcctgaccgcgggcctgctgggcccggggggaggggccttcctgctggggtcgagctgcagcgcacgggtgggcattagaggcacaatagagcaggttagttagagctcctggggggacagggcaggggcagggccgaggctggcgatgtaagggttggcctgccaggacagcacaggtagcaccaagggcgcagggagccggaaacgtgtggctcacacgggcccagggcgggcacgtgcacacacacaggcctgcacaggaagccaggggattggcacacagcaggcagcaggtcctgccatcgctggtggaccctggtgggctctcacacgcacatgcacagaagggtgcacacacactagctcacaggctctggcccatgcagggtgtggccgggcagtgttgtccccagtgggtgggagctgcaaacttgtcagtacccacagactgactggcgtgaaggggctgcttcctgggcttggccccacaacccagctgtaccccagggcccagaccagacccagcatggcctaggctgctctccagcaacccctagacacggggcctcaccggggacctgcccacagccacatgaccacttactttcaagggttccttctcagaggcctctcctgcagagctggcgccccgtggcctccgctccctccggtccaccgtggagtatccgtctgtagatggggtaaggtggggcatgaggggcgctctgagggaggccctgtaggagcagatctccctctcagcccagacacaggggactcgtgggacaggggctttgggagacagcccccacccaccctgtcctggagatccaggctggtgccagctctcaccaacaccctgccaactctccagactcccctccacttgtgggtcagagcccctggctgagcactaatccctctctagctgccctgtacctcaccctctaagcacccctaaaccaaatatctctcctccacccagcaccatctacaccccataaaaccagcaggcccacttcaggccttggtcccctcccggcacagaaaaccaaccacactgcatctgcactcacctgggcccagcgcatccatggggatcacatcccggctgccagttttctcgccctctgcaaggcaggaggaggagacgggctgcatgtggcagccaggggggatcggggcagagaagcccacacagggctggcccaggtagccctagaggctctctgtcactaaggtgcccaacctctgccagctggcagcctcaccccagcttgacaacagcgcggatgctgtgggaagggagtagccaagaggcagagggcagggaaagtggcctatggaagccgtctcagtgggaggcctgactcctccttcaccttcacccaagggtcaggcaactggggcagctggggtcgccaccctctaggctccctaagctccaccactcaccaaggctcttgtccaccagtggcagcgtgctgtcatcgaagcccccaggactcagtgctcccttaggccccttggcagtagcagcagctgactgagacataaaacacagacacagggtgggtgaagcacatggagtgggaataaggcaaagtgagcagggaatggaaggaaggccagggaagccgcacctggaagcgcgccttggtccaaccatctttctgcaaggtaccacgcagctccttgtagctccacactgtctgcagcacgtgtgacgccgccttcgcttcgcgtaccgattggctgtggggccgggggcggggtcagtggtggcccctcccccacctccgcggctccccaagccaccgaccccgcccctccacacctggaggccacgagagccaccaacgctggcaccccgcgtgcctgcaggagcgagcgcgcgttatccaggctgtcggacacgatttcgtggatggtgttgagcaccgccaccacggtgtcttcctccaggcaggcccccggtcgcggcggagcctgtgcattgcgcacattccgcacaagctcagccatggcgtagctccctgaggggcaggactaggtgtcagaacacacctctgccccacctctccaggaaggagcagggatcccgcgagggcgaggggcactgccaggagagcccctggagaccgcctgtgtgcaggcggtcacaggagcccctgtgagcagggcgctgagcttcagagacagggccggggggactggagctacctccagttgggacagcgcccaagcgagagggccggggcctggactcccaaaccactcatcctccaagcccctccgatgggaccccaaagctgcaggcacagttcggtgcccaggcgtgggctttgcaggcgtcctcaccgatgaggtctttgttgcgccggtccagcgagaggttgcgcagagcgatggcgacggcgcgcaccaccttgtcggtctcagactgcagcagttccacaagcaccggcagcccgcgctctttgcgcactgtggcgcggatgtacgtggcccactgcggaggcggggagagggttgctcagacatacatgccaggcactctcccacctccagacgctgaccgctctctccagctggaccttcctgctcccgtgcccgacaaagccctaccccaaaagctcaacggcacctccaccgaggttttcccaccgtccagggtgcacgcattgcccgcagcccatacacctcttggatcctggggtggtggtgtggcccctcctttccccgccagccgaggcaggagctgcaccagtgaggtgcctgggattccctctctcaggacttgcccaccctgcccgacctggtccctcaccatccagttgccggcactgaggttctgcagagcgccggcggcagcctccagggtgttgaagttccggctctccgtgaggagggagaggtagagacgtaccacctcgggctggtacagcagctcaaagcctaggtgcagggcaaccgccacccacggtcacccagaatctgctctcatccatcatacccctcccgcttcccgcttcagagctcccagggcgtgggtgagctggggccagggatgggtgtggatgagtcacgtaatatttactatcaacatatagtcacccaaggggaaaagcgttcccatttcacagaggaacaaactgaggctcaaatcagttggacctgcctggcagcaggagcatccaggaggcctggggtggggagggaggtgtcaaccaggaacgctctcctagcaacaagacccgcatttcccggtaggtccctgaagctatgcatcctggccacgcccctggtaatagggcccaccctccctggcaacaagaccagcattggccagtaactgagagttgtataaccaaggccacacccctagcaagaggacctgctttcaccagtaactgaagctgtgcagagagctacgccccctagcaacagggcccaccctcccccactgacaatagagcccaccctctgtaagtcaactgatgcagtgcaaccagggcagctgccctagcaacaggaggcactcttcctggcaaccactccaagttcccgggcaactgaggcgccgtcctgctgctctgcccagtgctccagaaatgaggggtcaaaacagccttccaagcttgcctgtctccaaactggggcttcagcctggcttgggtactacctcgatctcccctgtacccacccagtgacatttcatcacaccctcgccagtcctcatgccccatgctccctctactcctgccctgctgggctttctgctccaacacactccaagcacactccccgctggggtatctgcatcagccctgctctgcctgtaatactcccccacagccctcctgcggctggagccctccaccctggtgacatgcaggctcttccaactggctaggccccaccaggacagacctctctctcaagccagatcccagcatacagcccaataggcactgccctgtccctgcaggtgttcgtctggcccagcctctgaacctggatgtgagcatgcccgcctggctcccagccccctcagataactcagctttgtggctaacacaggaggccctgcctccactggaggcgtccctccaaaccttcccacctcttacgcaccgtgaggccgagcaagccctcggcctctctgtgcctgtctcccccaaccttgcctgacatgacccatggcacttcctcccattctaaaccctcagcaggtgtcctggtgctgaatcaccctccaggaaatcctgcacctaggggcctgtttccccatctgttccctgaggccctccaggcctgcttgatggctcaaagcttcactaccagggcaatcctgagcccagacatcccccagtggagctggcttcatctcagcccactcacctttggcggcctcagttcgcttgggcaggtctagcgtgtcaaagttccggtccatctcaccatccttctttcctggaagggaaaggtggtgggaggtgaggcagaccccatatggggaatgggtgtatcaggagagttgggcacagttctctcctacccaggccccaaaaggcacccccatgtccaggcctgggcacctgtgggagtggagcaccgttgtcagagtttgggcagacagtttagcctaggggtaggagttggtggcagtggggcctggggatgtcccagccctgcccctaggactcatctcccaccaggtgctgggagctgtaccacagaccctcccggtggctcccttgcaactgccaggtatgtagactgagggaagccaggagccctggctggatggtaggtggatacaagccaagaaactgaaggctgaccaggacaagactcacttgggtcacacagtaaggcagaactagggggaaactcccccagctggggtcaggacattgtcccaggatctactagccaggagaaaccccacagcagcccacctaacatttgtgtagccctggcttgcacacgtctgtgacagtgagcccactgtcaaccactctccccatgtcagatgatgcttctaccccttcagaaggcagcagagtggagccagatgacctggggtccctgccctgctcaccctcatgggacccttgtatccctccgagccacatgatgccccattctatcagagaaacagactgctccttggtgcccctagagataagtacccccgggccctgcccactcttggctctgcccaactctgcccaggtaggcaagtctgaggttacagaatgagccccgtggccttcccacctgccactgtcataaagatggcagcccgagtgatgaagccaggggtggggcagggccctggggctggaacgtgctcgcctcttcccaggtacccactgcacacgccaggcctggagagcaggataaaaagggactcaccttggtggaaccactcctctgggaggccggaggaagcagaggagagaggagaggagcctgaacaggcagcactcatcacccccccatgccctcccggaagcctcaggttcccactgcacaccctggatcaagcaggcagcatgtggaacctcatcccatcacttctgggcactgagcacccaccaggggtacaagaagagggaggcctggggtcagtggggcaggggcaggtggcgtacaggtcccccacagctgctggggaggtcctgggaacctacaccctgctagtgcagtagagaaggtgtgcagggcatcttgcccaggcagatggggggctgccccacaggttggtggcagtctacagctattctgtgaacagtgagcaggcagcagccatggctccttcccaactcatgggcaagtggaactctccccggagtagaaagactgggtctgggcattggttggtttcccttgtgtactccctgggggtcccacagtgtagatggggaaggttggacctgggtcccatcaaccatgtgacccagggcagtccagcctccttgactcctggcttccctgcctgcctgttgggggctgaccaggtgtcctctagcctccatgatgggctgctgtgggtgtacagagagccttccgctggggcaggagttgagatggtagagatgataccccagtccgccccacccacctttggccttcttgcctccaaagcagctggcatcatcccgcctccggcgctgggagcctacagcactgcccaggggcccgggctcggcctcctggtacctgtcggccccgggcacctccttgtgcacgtggtaggacaggttccgcatgatgcacacgcagttctccaccgactgcagggagaggtgagtgggtggggcagggcaccctaggcacagggctggccctcaggaaagactggccacagctggtgtgcatgagggcaccgggagcaaaggaacagggagtcctcagtggaggggagcaaaagggcggtaaccgccaggaagggtccatgggaggaagcctctgccctcacggcacaccttctgcctgcaggacggtgcccacttcagtgtggtcactgcgaggcgggccacacccagaacgccaccccagacccacaagcccattcccctgtgctgctcccacagttccagcctcctgggacctgcatgatcgtctctccagcccttggtatgaggctgtgaccgtccctgcccaccttgttgtcagtgtccttccggcccacagccgactgcagggcatgcaggagcgcgtccaccagcccttcacactcccggagtcgccgccgggcctcagcaccatcggagctcacattcctgtgtggccaagagcaggccaggtgacccctggctaccagaaactccctggctccaccctggccttgtgggcttgtcttcatctgcaaaataggccctgctgctgccctcctagcactaatgggaaaggaccccacagtctggagctcagtgaagggggagaagctaactgcccccaggcctcaggaggggagccctggcagacaactatcttggctggggatagctgggcagggaaagacagggtttccctgcctcccagctgacctggaaagggacaggtgcactctcagagagacctgaacctgtgcaagggcaattctgggtccctcgccaccccaatggcagctctgggccccaccttaccccaaggtcaagagcctgcagggctgcgcgggaacaccctgatggacaagcaggactgtggggacccaggactctgtggggtcagcagggcctcccaggggtaggaggggaagggcagaggtcacaggtggctgggatgagcctcccaggcagatgaacaggaaggtcccagctccccctctggctgtcaagtgatgggaaggtaggtgagagctgggcagggctacggtaccacagagacccctccagagggtgcccctgggaagactgggacaccacttgggggtgaggacagctccatcaggccccacttctcatccacaggacttgtgccacagctctgaagctcctaagctctggcgctcctaagctcgccgccatcttccacactatctgggaccacgaggacggggcctggtgtgcatgtgggctttagcaccaggtctggtccacacctcaggcagcccgacgtgttcttgaagacagttgtccactcggcgtcccgtggcttggagtcctcgttgggctcacgctcccatcctgagtggggcacgatcacctcgtgggtcagcgtctgcaggccatggtcaatgatgaccatcttcaggggctcataggatgacaggttccacagggtgcctgtggggtgcgattggccaatctgtgctgaccatatgcaccgcctgcctacctccccaggtggccacgctcaggacctgtcccactctcctcatgtcccagctcatgcagaacagtaggaagtaacaaaagccgtgagtggttccgggggacacccagtactggtttccagctaggaaggagccccaaaggggaggaggtgcagaggagggtgtggcagtgctgtcccgtcccacccattccctgccatgtggcaggtggcactaacactcctgaggccacagggcctcacagagacacggtgaccctacctgtccctcagctctcacaaggcacaagccccaccactgcacggttggggtgggaaccaaggaggtgggtcccaggagagtttctgtgggggcaggaggtgtgaaggcaggaggtgaggggacatgcccgaggggcgcagcgtcagcctccctgctatggtagagactggggaacctgtcacagtgtctgggcctgatgcctggctcctggggcaagcgtctcagcagctgcactcctgcctaccgggtgctttcccaggcggtcgcaggccgagtggcctcgttcctcccgggttgagcctcacactcttctcttcccaggggatgtgagcatggccaggtcccactcaccagtgacaagctcacggacctcgttgtcccgggcagccctcagcaggcgcaccagggcaggcacaccaccgcagtcccggatggcggccttgttgtcagtgtcgcggccataggagaggttgcgcagtgccccacaggcccggcgccgcacctcagcccgcgggtggtccagcagtgccacaagcagcggcagcccccgcaactgccgtacacgccgcttgacaccctcgttctcaaagcacagatgctgcaggtaggcggccgcattggccttcacggggtccacggggtgccgcagcatggccagcacctcaggcagctcagggtcccgccagcgcggctccttgcgggcgctatccactgagggcgagcgccgcaccagccggtccaggctgcccatgctgccccgttcaggctgggccaggggcgccgtcaccattgggaacgcaggccgctcgtccgccagctcgccgccatcatctgctgtgtcctcgtaggccctgcacaggcaagtggggcgcgtggacatcgtcacagcagccgccagccctgcctctgagctgccccatcacaccttcttcaggactgcaaactcacccagcagcgctgggctgagagcacctgtatcttggcccggagcatggtggggacacagagagtcatgcaccagcccagtgagaaccaattcagagccaaatgccaaaccccagccagcggctaccaggacccaggcaaccctcccaggacagcaaactcactcactgctgtcaccgggcagtttcccaatcccgagcaaaacaagtttctgtgagacatctgctatggctgctggagagaccgtctcacctcccttccacaaaaccaccccatcttccatgaggcccatctctggctgtgccaggatgtagggggagtaaatggccctctccgcatgaagccatcccagtaggaccacctgaggagtattcaggccaccagccccttggggcacaagatctccttagctctcagtagccctgtgggttgctgtcatcaaaccgcctgccctgaggctaggagtgacggtcaggtgacttggccagggtcacacaacaaaatcctgacccgggctgtggtcacatccccactccagagatgcagaaactgagggcaatggggacagaaccaggggctgtgacaagggccagggctctgggttctggttacccagagtgtggctggagcaaggccagtggccggcactcttcccagctttcctgggccctgggcctgcaggacagtgcccagccgaactcctaccaccccagggtccacctttcttctgtccctgacgagagccaaggccaattcaaactaacatgcatgactaactcaactgcgccacttgacaagtggggcactctgtagttggggggtggagggcagacttcccagaggaggtagccacaggggacggggtgcagctcacctggtatgaaggccccgcccacactcaggcctcctccttgtggccgtgccatagtcaggctccagctcagggccaccctcgtcatcagcggccaggctgcgcgtgtcatcctccaagccatacggctctgcctggaagcgctcgggcagggagcggccacctggtggcccaggctcaggacccaccgggaaggcttcccggtggccaggcagtgtgaagcagccatcaccagggcctgggccaagggggccagcacgtgggggccgcatgcccagccctcgggacaggctgccatagctggggctgtcccggggctcggggccttcgggaaagccacccccactgctgaggtaggctcgagagagtgtggccactgggccaccaccacgcagcaggaaatgccggtccagggcaccatctgcaaaagggcctagtggggggccgccatccagcagggggagtccatctgggcccacgggcacctggcgtactgtccgagtggtcaccgtcttgacagtcttggtgacctggtggatggataggcaggtaggtggggtagcacgagaggcctagaaactgctttgctggggtctggctggccttaatttcccactcgagcaatgagaggccccacgtggcaagcttccatgtccactctgcaggtgggacagctgcagcagcctggccctgctcacccacccactgcctgggcctggccataccttggtctcggtgcgccgggttgtgccatcttcggatgtgacaatagacacatgggaagtgggtgtgccggggtcctcctccaccgtcacggtctcctccagcacatcaggtgcctccggcatcgtggccagtgaggcctggctgcctgggctctgctcctggggcaaggagggacattggtgggcaggcctgctgctcagtcacccctggagtgcaggtctccacacacagcagctctgcctcagctcatgctggccagcacaccagggtgccttcctcctggtcctgaacccacccaccccaaggcctgtttcggcccaagctgacaaggacagcaataagttcttgccctctgaacatcgaggtgctaaccctgccccggcaccccatcctggggggaccctggggctggacccccatctcaggtctcctcaggctgagttggcagataaggacatagaccctggggggtgaagtcttcagggccctccccaagctgcatggcctggctgccacaggctcctccaggccccaggaggtgccagtgagacctgcagcatgccttcctgatgtcaaccaccacccctagctgggacatcatggtgtcctggggcctcctccctcacctgccccagacaccttgagtatagaagccttgtgggggctgtttcagcactgcctactgactcctgtggccacactaaggttcccgccaccaacgccagccagacgccctcaagggacagaaatacgcagttcccagaacaccccatgcacctgcagcaccagtatgtccttattccttccagcccagacattcttgagtgttgtgtaggcacaggtttgccctacctcgggccagtggctggcgcccccagtgactgagactctgggcatcatatcagagaccagacacagtagatttgagcctatgggtgcccttgccaccattctgcatggggtgacgacactggaattctaggcaagacaactctggactgagacttttctatccacatgcctactgactggacttgccagtggggaaactgaggctcaaagaggataggctggcccacatcagagccaggcccaacccctgccgcgctgagtggcttgaggacctaagactcacagcctgccccgggcctctgactgcacaggtgcctggccccagggccacatggcaccaacatccggggatcggcatctagccaggatgggcaggagctgaaacccaagccctggtgggtgggtcaggcggagcacattcccaggcagccagggcagggtcagcaggaggacaggtcctgctttgtggcccaggcccctggtccctgcacaatgggtcccttgcctgggccccctggggcctgcacagacactaagctctgccaggctccagaggcagactctgcccattcttgggcctgggaggtgagccaggttagatgctcagcgctgccctcaggacctgcctgccaaggctcgtgggctgggaagcctccccaggtcagggtcctatcctgggggaatacttgacccccaaatgcatgcagtgcaggtgtccaggaaggggcctgcaccaacatgttaggacaggtgtatccctcaggctgacagaggaaagaagtggccacagaaggcacctccccctctcccacaggcagggtcttggaggatgacagataactttatagatggggaaactgaggcctggcagggggaagaggatttacctagaacttcacagtccaagtgggatttcaagcacccccagagaaggcaatctggcaaggaaggctttgggcctcatctcgccctcagtcttgagatgtaggtggaatgcctgctgtggacctggctaggaaaaggggacctgttccctgggaaaaagaaatagactgaggcctagagtggggacaactggcacgctgccaggcagggcaggctgggctcttctccaaaggcactggggagctgggactgctctgaagcaggagaaggcttgtgtggcccatcactgctggggctgggctgccccatctgtatctggcaaatgtgtgtcaggccctgagctctctctgctgggccctgggcggggctcatctgagttcaagcaggggcccaggcactgaggggctgcagttctggcgacagagtgaggagggtataaagcaagactgaggaaacgttacccaggactctgccagtgggatgtagcccctcatatatgtatatatttacatctattaaaaactcagagaaaaaccccctcttccctagctaggcagtgggggtaagcgggagaggaaaaggggaggacatctcaggaccccgatgccactctgtggcccagcttatccctcccaccaaggctgtggtgagggtctgacaggcagagctggggtggtccaggagagccacgcccccgcagcaagacctggcaaccctgcggcaccacccatcagccccggcctagcagccccgcagtaggatccagaggccccaagagtccctgctggcaaatgacctcagggagctaaaaacgagggatgacttcacccgggtggcaggtgcatgagtcagccagtgatcacaggaaagcccggcccctgctacacatgcccaggcacacacacatgcatatacatgacccctcagacagggacacatgcatgtacatacacgtgtgcaagtacccagcccggcacaggccgagcacatcaacccgtgtgctctaacagcaccccaagggcacggcgcccactgttcccagaggcacactcgtgagcacacatcctcccgtcctccaccgtgtatcggagacccttatccatgcagggcctcacagagtctcaacacacagggacaggggccaccaactctgccaatcatctgcccagcatccactctgggagtctcagagctggctggcagatggagaaactgaggtgtagagtagtgagaggcccatagccagctggtggctcagctctctgcaacatctttagggtggggctgtggaatggtgggctgactctcaacaggagttggctgcagtccctggatccctgtctggccccagtgtccatgtctgacgtgcacctgcccaggctggcccactctcagggaccctggccctgcagccccacacagcctctgcctcagacccaactctgggctgctcccctctgtaccctagacatgggctctaccctgaacaccccacctccagcccaatcccacatgctgcatcctgtcagtcgtctctcatcaccccctccccagctggggccccatccttgctcctcttgcaccccgcccggcctcccagcactcatccctcccttggctcttcaatctctggtgcaccaggtctggggcccccaggactggcccagaaacaggctgctgcccaggcctggggtttcccatgagctcccttgggcttgtgggaggggccagagtgaccagggaggtagaccacctacccctgctcacaagagggtcccgggaacacagggctgagcccagcataggggctctgggccccatcacgcaccttcggctcagcttcttcacaaggaggtgagaaggacagagggggctggggtcgtgggacgtgctgggtagcatcagtctcacttttgtggcaaaatgcaaggaacacagggagcagaaaagcaagattggaccaacacacagagggatgctggggcacaggtggctgggccctggtcccatattacttatctacccaaaccaccggacttcacagatgcaccacggtctgtgtcctgaagaacagactgcaggggcaggcccctcccctgtccaaggcctggctagcacacacagagaatgagttaaggtgagattgcacacctggatcccacacctgcaggccaggctcccagagggcaggaggtggctgctgtccgatggatgaatgaatgaatcttctccatccccattatggccctcccaggtagagtccaggacaagccaggctggcatctctcaccaggcagcaagcccttggccaccacaaaatgccctttcccttggtgccacagcctctgaccagtctccaagacctggagcttacttctccacacagcagtgcacctgccagggcgtggccccaggcagagatgccaaaaagccaagctgggggagcaaacttggggtgggagagcagggctgactgtcatccacctcagcttccccaagctcagcttggggtcatcagacacactgtgaccatggatttcccaaaaactggtccctccacctctgagggccagaccctgggggccacaccagggccgtaggacaggcaggggcctagttgcccaggtagcaggtgtgtgggagacctgcctcccaccacagagggtcttggctggtctctcctctgctcagtttccctgcctgttactgaacccagcactgctctgagcagaggacaaactgcctatgcctccccccacctcaatgctgagagggggaggatcccgttttccttagagatctcctccagcatccattagtgggcagggcctgtctctatccctcccatcacgtgcgcctcggaggcagagaagacttccattaaagctccggaagctcctttgcaggtcccgggagtcagagccggcgtagggggtgtggaggggagaggaggaaccctctcagggagcagaaggcctacccgggcttccctcttcagacttcagcctccttcctgcacagacagaagccgctcaggaaggccctggctctccacccgtgtccccaggcacctgtcctgggcgctggccaagaagcgtccatccggtccgggccggtgccaagaggagggtcaaactgccaggggtcccgacccccccaggccccgcggatgggctccagagaccctgcggcccgccctgcatacccgggggcaccgcgctcacaccgccacccgcccggccctggccccagcctgacgcagcccagccaggggcgcaagacaatagctgcctcgggccagcggctccgcggaacaaaagcgggtcctcccgggcaggccgacgccccgccctctgcctccgaccccgggccagggtccccccaagccaacttccctccaacctgtctgagttcggccggcatcgggccgggactcggggggcgctggccagcagcgggggaggcggtggctggaccaggctcggctccggcgcctcggccgctcgggctcaggctcggcggactcgctccccgcgggggcggatctggcggcggtcacggcgagcagccaatcgggcggggccgcgcccaggtggggcgtggcgggggccggggtgggcgtggcgggcggggggcgggcaatgtgaggtcccgccccccagagacagggggcggggccctgcagccccgggtcgccccctgtccccccacttcccaccacctccccccacccactgccggcctggacttctgctccctccccctccctgcggcaggggtgtcactttcccgccgaaagactttggccaagtccttcccaggcctcggtttggcctcggtttatgaccacacttcagtccgcctgcaaagggggaaacagttccggcagggcaggtgcccgtgctgcgatgcacagagcacaaggcctccctcactggcacaaacctggctgcgactcagtttcacctgccatgaaatgggggccgatgagacagtagtcacggctctgtgagatctctccagtctcccagatcccccctcaccctcctgcccagccgccactctgaatgggcctgcgaagaactgtccccacagagttcgatggggacctggaaaagggccctgcaggggacccccactttgtatcttgggttctccccatcgaggcacagaagccccgaatgcacccccactgctcccccaggccagcctcaatgtgggccacaccctagggaatctagttctgctgcagtgaaaaatgggaggggaagggccaggctggagccaccttcttatgtcaaaccccacaaaggccaagccaatggctccagcatcacgaacagggaaacaggttctgagattaaatgagctgagaccaacccagggagactcagtgggtctggcaagagaaagggctcgggcccaggcctcccactggcttctccgcagacccctcagaaaacagcctccgcagggaccactccctgctgccctgagcgccatatacagaggccactcggctagcatgctcaagattctaggtacccaccatgtgcccctctgagcctcagttcccccacctgcagaggggtgagctaccctaccactggctggacccctgtatcttgcatctagggccaacctgcctggaacccctggagcagagcgcagaagaccagacactgcgccaaaaacgcgcccgcatcttatctttaagctggctccatcttctcaactgcaccagcagctagtgccccagccacctatccacctaagacgagcccaaggcaagttccctgatggcacccctccccactgggtgggcgtcagccctgtttcagctggctgtctagaggaggggccccttcctgctggaagatgaagggcaggtagccaggaccctggagcagcccagtgagtgcagcagcactccccctagcctggttccccagcctcagcccccagctacctgccttgccattgccctggcttcccaaagcccgggctctgaccctgtggctcagcaggtagatcgctaggcacttcctactgaaaccaatctgggaaacctggccagcccaaggaggccctgcctcccctagtatcctcatcagcccagccagttgagctgcagccctggcaacacatgctctcttcaatcccagcctgagaaaatcaagggtagggggtcggggggagagttcaggggcaggggtggtaggtggaggggcagtagcctgaggtcttgaagtcttttgcctgaggaggtcagggtagctccaggctgtgggaacatcttcccaccagggcatcaaccctccggggtgccttgggtcctcccacactgcctgtccgaggacagttccggtctgggagggttggactgagcacactggcgcctgagaggcggcctcggggtcactggcttccactgtccctatatggcccagctgggcccagcgttctgcttccccgcctcaagtttgagggtagaggcctcacattttggagtatctcaagtctgagggctgtgagagtggccccagcaccgagacccaccagaggcctctgagcaccaggggccatgaaaaagggccccctagtgagtctcggaccctctggggacattaatttgactctcaccatgcactggtgctgggctgggccttctatgtgggtctcatgagcagacgtaggaagcatgacgcctgctggccgacaccaagtctggacaccaagactcaaggagtagtcaccaaccccaggtccctcggcctgacacaggctgctggttctgagccccacatgccccagccaggtgaggagagcccatggggctgcctcaacagagaccagcgtttgctccctttctctctagatgagaagggccaggctgccccaagctcctggcatgtgtgtgccaggcgcaggtccccagagtcagggcccagcaggaccaaagaagggcgggtggaggtgcaggtgctgggagtatgctggggggaggtctggctgctgggtttagcggggcagggagctgagccagggagacaggactctgcagggagagccctctagggtcactctgtgaagaacccagaggccgcagcaggaggcaacccccccagcctctaagctgggtggtgaggagagcccccttccccgtggctgctgggacagctccaccctgactccccactgtgctagccctcagtcagtaacaggaaccatgataatcacaccacatcccaagtctccctgcatgtacttgttccggcctcctaaccccaagccaggggctcttgctgtttcatctacaggttagagcactggggtgctgggaatggggtgtcccagtggtctaactgctcactgcataccccaactttagagttcttagggcctggccatggaacacagaaggctctatacctcctgaggctgagtaggggccggagcccagtctgaggataatggccagcagagaaaatgaggctcccaggtcagcctctaagctgcaggcagagctctgggcctcctcctggggctgacccaccagtgcatgcaatgaacactgtggcagggttaggcatggtgcaggcaaacccctaaagtgtctctaggcagaccaaagagctgcccagaacagaccccatccagctgcctgggccctgagggctcagtggagggtgctgttctgagtgttgggctgtgtcctgcccactcttcacatggtgcctagtacacccaagtgggacttccagcccaacctgggatcccattttcctttcctccccaggagccccagcaaatcttgcaataagcgagcgcatgctggcttgtggtccaccaggacccactgattgttttcccacttggcaattttcacccttcccaagtcactaggctgttacctggaggaccagctgttgccaggccattggcaggggctgcccactgcccatgccaccactgaccatgccaggctgctgggcacgctccagctgtagggcaacatggcgccgctcctgctccagtgcccgtgtcagcctctcgaagcgggcctcctgctccttcaccgaggccaggatgctggcggccgagtgcacattgcagtcctccatgaccagagcgcccgccagctgcaggcaaagcagagtaagctcagtggggtggggcacagcctggcaaggccatcatgggcccctgcccgccccactcacagaccatacaactcactcccagaccagagcatccagccctctagagggaagcacactgattaaattctaaattaaaagccattaatccgaggctggccggaagcagccggctcactccccatgggttttgggactctaacctggctcctctgcttcctgctagacctagcagaaacatgggccgtgggcggcttggagcccgctgggaagggcaggaagagctcattagagcttcttacctcccaggccctctgccactcataccacatgccagcccaccctccatttcacagggccaccccactcccatctcacagaggcagatgccagggccaagaaagggtgggggaccatttgtagccacacagctggtgtggcatggccagtgtggccagcaagcagggagtgagaagctgctccactgatgggtgcccaagaccccgaggcaggcgcaggtgaccatagcctgagagctcctggcaacactggtctgcagaccagcagtccagcctccactcatatccacattggccagaaacaagagtggtgctgctacacatgacagagtaaaaactgaggacaagcctggttgaggttctggctgggactgcatgaagttaagagaccataagcctgaagtggctggtgtgtgtgatgcctcatccagaaaagggcaggggccaggcatctgaggccaagcacagggtgggattgggcctgctgggcccagcccagtgttgcccctcagggccccagagccccaggggagcaggcgggggccatgagggcttggcagccgcagagacaaaccagcactttccctcccagcttgccccctggctgcccagaatgtttgtttttcatgggtaaaaagaagcaggacaagtatgcggagctccaatccaggctcaccacagtgggcagggcatagccacgaggccacactgcccggagcacagtgagcatggccgggtgcccagggctgctcaggcatcctcctgcccagtcccgccagcccactgaggccaactccgctggatcccttgcccttgcaccaatatagggccctccacggggaggacacgcactgcgggtgacatccccagagcgtcagcactgctgctcactggtctggatggagccagctgcaaggacagagagcccccaagaggaaaagcagcgctgggctcagctgcgccagcaacacggtgcggggacatgggtgcacctcataggtgaagagacactgtggagcccagccccaccgacagctgggaaaacaggcccagcaagagcgagagaccagtgcaggcccccaaagctgctctccatttccccagcacctgtcccacaaatgaaactgtcaacacaacctttcggggaagccagcatgagtggaggagctgttttaagccagccacagaatggaagaatgcagggagagctgggggccgccgcccgagactgaggtgcagactgggcgctccagcaaagggataaacagcactgcactccccaagcatggtcacacagctcttctctacacacctgatgctgtctacccacaggccccagacccaacacaggggagccttgtgcactaatggactgaacctagtgctaggcccgaggtgggaatggtagggtattccccctgggacggccagggcggatggcagggcccatatcactccagccctcagcccagtcctggctgcagcaccagcccatctcagccgaacctcagaagcaagggacagaaggaaatgggacgctgccttggatggcaacaatcaggaccacaggatagccactggcctcatggacctggggtggcttacttccctccctgtgcagagacatggaccctcgtctacaccacacaccccatcccccatctagcaggaccaggcttgggctgcagaccctgcggacagcttccctgacctaagcccctccagcacaccctggctctggggactaaagatgcccaccctaaagggggcccactggctctggctgagggctcagtactccaaggccacagtgggaaggtgaccaaaccccacgatgaccttctcattgccgaacttggcttgattggtgcaaaacaatcatgtatctccctggaaacatccagaaacactggccagtgttgtggggagagtctggcagccatgctcaggagagcagagaccttggtgctgggcctgtgccatctgccccagccgcagggtgcaccctgcatttgccctggggggaagtgccctaggcccgcaggtcatggcctcggcatctcaggtgtctcaagagcaacccgggatatgctccaggcagagcacagaaggcccaggcccactcccctgacatggtggactctggcctatgacaggagccagtctggatacaagggatcctggcccagaaccaaagagggctgcttttcagatggtaactcaaaatgctgtttttatattcaagtaataaatatatgatgtcaaggaaagcaaaatgtgcatggattcttaagatcgatggggcctgagtggatgctgggcagagtgggcaccggatttgcttttgctagagcccaggagggccctgggggaaggctaggaagggggacactgcagggaccttggctgtccagccaatgccaccttggcctcccctaacctggtaagggcccagcattgccttgtcgggtggacccctcatgaccccccacccaaaacacagcaaccagcttcatgcccaactctgaggaggccacttcttgccaaacatgctggccccagaagtttacttagccgcaaggcaggaatgacattgcacagcccacgagtgaccagacttcaggaccatgtggacaacaccatgttccaaccagaaaacatcaggaactgaaggggggctggaaaggtcggggctaaactgaaactctgaaaaataaactgcaaaacaaaagtgacgacccagcccccacccagccccagccacaatggacattggccacgtacccaagggaatccaggaccaggacgtgagcctccaggtgctctcacaggacaaactgctgggcaagcaggtggcccgaggagagaagcatggcaggagaagagggtggccccaggcacacagcccatggaagactagagggagggcaagcaaaggagagacagcgaaggatggacagacagatggatacaggggtggatgggggatggatgaatgaatggagggtggctggggcagtggtggaggatggacagagggacggacagattgatggacaggtcggaggatcgtgggagatggacagagatgaatggatggatgggggatggtggggaatggacagatggatgaatgaatgggtcggggggatgctgaaggatgaacttatagatgaatgaatggatgggtgggtggagggatggtgggagatagacatacagatgaatggatggatgggtgggtggggggatggtggaggatgaacaaataaatgaatggatggatgggtgggtcgggggatagtggaggaagaacatatagatgaatggatggatgggtgggtggggggatggtggaggatgaacatatagatgaatggatggatgggtgggtggggggatggtggaggatgaacaaacagatgaatggatggatgggtgggtggggggatggtggaggatgaacatatggatgaatggatggatgggtgggtggggggatggtggaggatgaacatatggatgaatggatggatgggtgggtgggggatggtggaggatgaacatatggatgaatggatggatgggtgggtaggtgggggggaatgatgggagatggacatatagatgaatggatggatgggtgggtcgggggatggtgggagatgaagatatagatgaatggatggatgggtgggtaggaggatggtaggcgatggacagagagaaaaacagacgcatagatgggatggtgggggatggatggatgaacgtatggatggatggggggggatggtggaggatggacagacggatggacagattggggaatgaggggtatggacagacagacgggtgaatggatagggaggtggatgaagtcatagaagggtagacagctagatggatgattggatgggtttacagatgaatggatggatgagtaatagatttgtgggtgggtggctggagggatgggagaagaggaggccagatagaagggggtgtaactgagtgagtgaacaagtgtgtggacaggagactaataggtggttatataagaaaatgaggggagatgagaggatgggtgaatggtggctagttggatgggaaggtggctggatggatacgggtggtggtagagggataaaatgatgatggaagaatgtgtaggagggtgggcagatgggatgctgaaggctgggtggatggaggagtggatgaaggagaaaacagagtgcgatgcatgaatggaagggggggtgggctgtgtaagggccggtgggcaggaaggaaatgctggaacctcactaagtggggaaagccccggcccgcaaaccctctggggcaaaccatggtcagcacacactgtcaggaacacgaaggcatggtgaggaacctgagggtagaagctaaatcctttccctgaaaccaaagctgacatttgacgacatcttgccaacccagacattcctcctcgggagtgcggccagagccttgtccggaaaatgaaattatggggcccgagtccagtgtgggttgaggaattagaggaatttccgaagggtcaggccagtgaagggtggcaggcggggcctggctcccatcctgaccccttgccagctgtctaccagaacacagccagggctgcgctggcccccccctcgaggggagagacgggacggatgaccatcgagcctcctcccataccccctttcccctccacccttccctacaaggaggaaatgatgccagaagtgccctggcaggagttggacccaggcccagcacccaccttctgcctgggaggacatcctgggagctgccagcacagagacttcctcgtccccctagctggccaggccttgtgggggccccatgtttaccctgttgcccctactgtggtcagatggtgcccaaagccttgtgggtagcttctggccaagcccactggccgggcactgtactcaagctgggacagggccagagccgggggcctggggttcacagggcggagtccacatccatctgtgccaaggccaggaccacagtcccttgcagactgtgttggatccggggtgcctgggctggggatgactgttctcagcctccaagcagcagaaagaacccccgaggaaagacgcacaagcgtgactttgtgagaatgaaactttctgtatatccaaaaaaaaaaaaaagggccacacagtgtggtcatgttttttaaagaactgacaccatttagagcaacacatgcagtgagcgttttgatgaaatgacgggtgctggcgttactcgcagaccatgactccagcatggtgaggctggtgtggggtgtgcaggacccatcacactaggctctccacttctgtgcttttgtaattttccataatggaagaagcagccacaaagaaaatgaaaagacaatcgacatgttgggatcaagtatttgtaacatacaacaacaaagtggcatcctcagcccattaggtgctctcataggctgctccagagccccacagtcctgcccctgccagtctaccactcctcgaagcacgcgccgctggcataatcagaacctcagtaggaaatagacaaaccagataccctccccaccaggcaggcgagtgaaagcagaggccagggaccaatctccccaggggccagggcggtgcccactgtcagagagccataatcagattcagcctggaaatttgatttccccagcagaggcaatgagccaggctggatgagacgccatcgggggttgggtagagggacagagatagctccccaggctgtccacatgctcactcagtggcacccgctgatcatgtgagggaccactcccatgtccagggagaatactcagaaagggcctcttcccacgctgctcctgccctgcactaatgcagtgcccaaggccaaaggtggccaagaccaaagctacactggccagccccagggggcatgctggatgggaggtccagggggactaggggctgtgtggggctgatacggaagctggggtccggtcaaggcagggtcactgctgggggccagggagctgggaagcctaaggttagggcaagggctggctctagtggccgaacgagcccagtgactgcaggcaggacgtgacaggtgagcaggcagggcaggcgagtgtcccagcaactgtccctcctctgtgggaggcatgagccacagggagccactgctggaggtccctaaagggtctgggcttaagattctcaatccagcaggtcacagacacctgctccctgtgccaacagcagcatcctttaagtctccttggtctcctgagacctgcctctccatgaggagacatgagatggggtggaaaggagtcctccaggtcccgattcaaaacagcccccaatgcccttcctgtgcctgacccagactctagctacagctgcagcagtgggtggtcctgcagactccaagccgtggagtagtggcagtgaggggccacattctctgggctccctgctgcatcctgcccagggcaccaccaagggctcaaaggctggggagctccagggagagggctgcagaggctgccagtgcagtgtcttctcccctgcacactcagcccacccactccgcccccaatgatgagcatgaagtttgtaggagtgtggagaggtgtagtgccctactaagtgggccggacattggtggcggtggctggcccattgcctccacggcttaccgggacgggcacccaccccgcaaggtgccgtgtggcccatgccctgccttagggagggcaggcgcagtggaggcggaggcggggtgtaaaaggcccagacatggagctgagccccgtcctctgtactctggggtgggcacagggaccaaagcatccctgaggagcgaactgacagggttcacagctaggctgggatcagaggcagacagccacagggcctgggagccctgccctaccatgccctacggccccactgaggcactgtaggagacagctgtccaccaggctgaggggcctcagcgggcaggtgcagcagtcaccacgctggccaccagcctgagtgcacagggccgtccgcctgcaacgccctttcccccctcattggaagacggggttagaccccttcttcccagcccctctatcaccatggaaacacccaggcttctcctgagggacagagcctctttgtggtgacacaaagcccctttgaggggaggtggggtgcagcccctgggagcctgtggccaaagggcccctggggggtaaagcagggcccgccggcccagcccccctcccaggtttcggagccaaggaagctgaggtaggagagccttcaggttaggccagcccgccccagctgcccacccagaagggtctccggatggatgagccggacagcccaggaggccaggctgaggctgggcagagacagcaccgagaagcctctctgcaggagctggggggttcctgctttcccctctgttgttttgacaaagaacacactctgcttagataagtggaaaacagcactggcaggggagctcccgccagtcaggaaatgcccaggatggctgcaggaacagtgcctggtgggagatggggacaggaagtcctccgtgggagggcaggcaggggccgtgagacggcaggtcagacagtgggaggtctggcaccaggtgtgccgagaggactggccctggcatctgggccccactcagtttactgtcctctcacttctcaagcctcagcctccgtcttcacctatccgcccagggggaaatgtcactggccttgctgcagccacaactctgggacaggccagagttggataaaacggaacctcaccatggcttggcttattccagggctggggaaatggaaccctgaggatgatgtgggtccctggcacagtgacagcatggctgtcccatccatgctacagccccacagccagggaggcagaggaggccaggccacatttccccagactcccagccctggagcccctcctgtactggcctgagagtccctgcccccacccactgactgctgctgaccaggcacctggcagctccctgcatgtgggcgccctgcctagaggccctcccgagttgacctcactctgacccacagcagctttgctaactaagcccctggggtggggttggggtggggatcactggccccctgcggcagcacgaggaggcactggcccagggagagatccatccttttgtaggcaaatctacctgactactagggagtggggccaagggctgcccccacagggcagtgcctgggtcagcaagcacttgctgcacccccaatggaggccctcaccacacccctcccaacctgccttccccactggcaccccactctctgctgacacctgcaggcacaggggtgggggttgggaccctccagctgccgtggcagggagtggccatagggtggttgctgtggtggacgtaggccatatggttcagaatggatcagaggatggtgtgggtgggagaattaagtctgggctgaccgcaagggatcaggcctgggtggctggagggaggggccgggaccctgagtgggagggtgcaaagggagtctctgaggctggagaggctgagggaccactagatgcatgaagttctggaagaaaggggttcaggctggagacagaaccaccggcaccttcagcctgtgaagccgagagataagacaggtgcaagccccactgcctcctccaaaggaccctcccctgaccttctagaacaaggggacaaagtcactttcccagccatcatcttccctgcactggaaggggcagaacgaggacccagcactgagaggtgagcctcaggaaggaggcagtgctgccagcccttggggacaacagcctgtcccctgaaagtcccaaaacccttgggaaaggtgctcctcactgtacccttctcccacccagcacatcagaggagccagtggtgtgagatcttgacccagcatgaagtagagcccaccctgtcatatgcagggaggttccatgtcccctttggtctgcccttgccccagggtcctgtgtggcctctggccagagctggctgctcccagggtgcctggggcaccgctcatcccttccagagcctgagctggatgctggccttgccgctcccaaccccctcctctgctgggagccagctccactccggagtgcccatggcaacaggcctagacaccaacctccagcaagtgcacaaagtcctgcctttcatatgcaagcaacacagagggccaggcagggggctgcaccaccccatccagggcagattccaggccctgcagcctcccatctggctcccaccgccacataccaggagagcctcgggacttgactgtgtgtccagtccccactacaaagaggtgggagaagtgctgacagtttggggccctcctcaaaggcacctactggcacatgtgtgcagccacccacactgctacggtgtgaatgctagtgttccccaaattcacattaaaacctaatctccaatgtgacagtattaagaggtagggcctttaggaggtgattagtgcccttatatgatcagtgtccttatcaaagcggctcttgagggctggtttaccccttccaccatgagaggacacacagcgccatctatcaatagccctcaccagacacggaatctgctggcgcctcgatcttggacttcccagcctccagcactgtgaacagtatgtttctgttgtttataaaggactccatctaaggtatttggtggcagagcgtgaatgaactaagacacacacagacacacacacaagcacacccaggcacagggacccacagctgccccacaggcacacgcaccagcaggcacactcgtccacacccatatggctgctgcttatcccacctagaagtcccgacaggccctttggggggtgggggacatcttggctcctggtgaagatcagcatgctaggcagactccattcctgtcttggacaccgggcaaggcagaccccctctgagacccctgaggccgggtcaagcctgcccctgacaccaagatctgcaggaccccctgcctctgatcccacatgaggttcctctgagacaggtgggagtggctgggcctgcagaccccgagcttgcacagacccacctgcagggacaagcacaacttacagcagcctagtgcccagggaagacccttccaccatgggaggactcaggaagccgcttcccgctgagtcacatttagcgcatttcttaggaaacagctggtatgtgccctagaaggttaaagacggtgttcaactccgctggccacagaccacaatgaaaaggagctgctggctgggcacgatggctcatacctataatcccagcactttggaaggccaaggtgggaggatcacctgaggttgggagttcgagacctgcctgaccaacatggagaaaccccatctctactaaagatacaaacaaaattagctgggtgtggtggtgcatgcctgtaatcccagctactcaggactgaggctgaggcaggaggcagaggttgtggtgagccaggatcacctcactgtactccagcctgggcaacaaaagcaaaacttcatctcaaaaaaagaaaagaaagaaagaaaaggagccgctataaataatgaggatcccatggagatttaaaggaaatcccagcagaggcagtaaacagcagactgtagaaaacacgcagtgtgaggctggagaaagtacactaagacggtcctcccaaccccaacagcaaacaggagagatgacaagaggatggtaggagccacagaagacagagcccagggccaaacttccacatgataggagtttccagagcgagaacgacagacagtgctcttccaaccacagaaaaacggccagaaaccacctcaacaggagtacgtccaacggggctatcagcgtcagggctggaatctgagttagggtgtgagccttctgtccagaaaagaagcccaggaagtcacggatgtgtctacctctggcttttacaattcagtctcatttcctctggctcctaaatgcgctgtgtccacttcgaggtgtagggaggagggtgcccagctctgacctgcgggctgtgctgaagcctgggcctctctctataccaggccgtctgcaggcctgcaggggctgcatactgtccctctgtaaatgtcagcctcaacacgctgctgcctgctgcctggctcccgtctctcacagctcagaagctgttttatgataaaaaagagctgacagctttgttaaaacaaacaaacgcctctcctctctacttgagatcttttacaaagttaacatcgctctgaaaccccataaggaaaaattatggtgaggtttctggattttcagaggcagcaaactcatcttacctagagccctggactacccagagaagtagttttaagaaccaaaagaagagaagaattcaggagtaaatgaggcctggataacccaagggatcctgtgcttgcactgctgggattcaaatttgggggctgccaccaccacaagtttgtgagaagcccacagcctgcgcatgaagattgtgtcaagggaatagcagctgctgatgtgtggaattgattttttcagcaagggcctgcgattctgaatgcattaaggcagctccagttgtctgtagcagtcctctgtcagctgcccattggaagcatttttactggctcaggaaattcatgggtttgtggactgatgactccaacagattaggtacaaatccaagaaccacaaaacaaaatctaaccaagccaaacaacaatcaaacaataaaacagaacaaaaaaaaacctcaatttgttttccttttctttgtataacattaaaataaaaagatggtaacagactaccataaagaattatacaccaacaaattagataacccagatgaaatggaaaaatttcctagaaacacacaacctaccaagactgaatcatgaagaaatagaaaacattgattagatttacaactagcaacaaaactgaatcagtaatcaaaaacctccagcaaagatggtttcactggtgtattctaccaaacattcaagtaattttaacaccaatcgtcctcaaacttttcccaaaaataaagaggaaggaacacttcctaattcattttatgaggtcagccttaccctaataccaaagccaggaaaagacactacaagaaaagaaaaccacaggccaataacccttatgaatactgaaacaaaaattctcaaaacaaacaaacaaacaaaaaaacactagcaaaccaaattcagctgcattttacaagaattataaacctaaccaagtgggattttactcctggaatgcaaggatggttccatgtacaaaaatcaatcaatgtaatacgccacagtaatagaataaaggacaaaaatcacaatcatgtcaaatgatgcaggaaaaacatttaacaaaattcaatagtctgtcatgataaaaacactcaaactaggaaaagaaggaaactttctcaacatgatgaaagctatatgtgaaaagcccataacatcatactcaatggtgaaagactgaaagcttttctcctaagatcataaacaagacaaagatggctgttttgaccacttccattcaacatagtactagaagttttagacagagtaattaggcaagaaaaagaaataaaagacatccaaattagaaagaaagaaaaaccatctctgttcatagacgacataaccttatataaaaccgtaaagattctacatgcattttttaaaaactctattagatgtaaaaaatgaaatcagcaaaggtgcaggataaaaaatgaatacccagaaatcagttgcatttctatatatgaacaatgaacaacctgaaagggaaatttaaaaaaactattccatttacaataccattaaaaagaatagaatacataatactaaacttaagaaacttaagatctgtacactgaaaactataaaacattaccaagaaaaatttaaaaagacctaaatcagtggaaagatatcccatgttcatggctgggaagatttaccactgtcacaatgacgatactactgaaagggatctacagattcagtgcaattcctattaaaatcccaatgacagccaggcatagtagcatgtatctgtaatcctagctagtcagaggctgaggctaaagaactgcttgaacccaggggttcaaggccgcagtaagctaggatcacaccattgcattccagcctagatgacagaacaagacctgtcaaaaaaaaaaaagaaaagaaaaaaaaaatcccaatgacattgtttgcagaaacagagaaatctatcataagatttatatcgatctttaaggagcccaaagagccaaaacaatctggaaaaagaacaacatttaaggactcacacttcctgatttcaaaacttactacaaagctacagtaatcaaaacagtgtggtattagcataaggacagacacaaagaccaatggaatagaatacagagcccagaaacaaaccctcatgaatacggtcaaatgaccttcaataaaggtgccaagaccattcattagggaaatgatggtattttcaacaaatgatggaactggatacacacacgtaaatgaatgaactcacacccttaccttattacatacacaaaaattaactcaaaatagatgaaagatctaaacataagacctcaaactataaaactcttagaagaaaatataggggaaagtcttcatgacactggatttggcaatgatatcttagataagataccaaaaacacaggcaacagaaggaaaaataaattgtactacatccaaatttaaaatgtatgttcatcaaaggacacaatcaatatagtgaaaaagcaaccaacagaatgggagaaaagatttgtaaatcatatatctgaaaaggaattcatatccagaatatgtaaagaactcccaaaacttaacaacagcaaaaaaacacaaataacccaatttaaaaatgagtggagttgaactgacatttctccaaagaagatatataaacggccaacaagcacgttaaaaaatttgctcaacatttctatcattagggaagagcaaatcaaggctgcaatgaaatatcaccttacacctattaggatggctagtctaaaaaaaaaaaaaaagttttggcagagatacagacaaattaagacccttgtgcactgctggtgggaatgtaagatcagtatggcaattcctcaaaaaattaaaaatagaattaccatatggtccagcaatcagaaaattctgcattatgtatctaaaagaattgaggccaggcgtggtggctcacgcctgtaatcccaacactttgggaggccgaggcgggtggatcacaaggtcaggagatcgagaccatcctggctagcacggtgaaaccccgtctctactaaaaacacaaaaaaattagccgggcgtggtgacaggcgcctgtagtcccagctacttgtgaacttgggaggcggagcttgcagtgagccaagatcgtgccactgcactccagcctgggcggcagagcgagactccgtctaaaaaaaaaaaaaaaaagaattgaaagcagagtctccaagagatatgtgcacaatcatattcacagcagcattattcacaatagccaaaaaggggaagcaacccaagtgtccaccagtggaaaaatggataaacaaaatgtggtatagatatacaatggaatatcaggcatcaaattctgacatatgatattctcatgatactaagtgaaataagccagtcacaaaaagacagatactgtgagattctatttatgtaaggcatctaaagtagtcaaacaataggaaaagtagaagcacttcaagaaaggggcaaacggggagttttctaatgggtacagagtttctattttgcaagaataaaaaaaagttctgaaattggttgcacagcaatgtgaacaaacaacactactgaattgtacacttgaaaatggttaagatagtaaattttgttatgtgtattctaccataattaaaaattaaaattaaaaaagaggctccctggccaggcgtggtggctcacgcctgtaatctcagcactttgggaggccaaggcgggcggatcacgaggtcaggagatcgagaccatcctggctaacatggtgaaaccccgtctctactaaaagtacaaaaaaaattagccgggtgtggcggtgagcgcctgtagttccagctacttgggaggctgaggcaggagaatggtgtgaacccaggaggcggagcttgcagtgagccgagatcgcgccactgcactccagcctgggcggtagagcgtgactctgtctcaaaaaaaaaaaagaggctccctcacataataagtaagaaattgcataatacccttttatttatttattttttgagacggagtcttgccctgtcgccaggctagagtgcagtggcgcgatctcggctcactgcaacttccgcctcctgggttcaagtgattctcctgcctcagcctcccgagtagctgggactacaggcgcgtgccaccatgcctagctaatttttgtatttttagtagagacggggtttcaccatgttgaccaggatggtcttgatctcttgacctcgtgatctgcctgcctcagcctcccaaagtgctgggattacaagcatgagccaccgcgcctggcctacccttttgaaataaatagtatatcaaaggtaaaaatttaaggctgggtgcagtggctcacacctgtaatcccagcactttgggaggccaaggcaagtggattgctggggcccagaagttcgagaccaacctgggcaacatggcacaaccctgtctgtacaaaaaatacaaaaattagccaggcatggccgggagcggtggctcacacctgtaatcccagcactttgggaggccgaggcgggaggatcacctgaggtcaggagttcgacaccagcctggacatggtgaaatcccatctctattaaaaaaaaaaatttaaaaattagctggtgatggtggcaggcacctgtaatcccagctactcgggaggttgaggcaggagaattgcttgaacgtgggaggtgaaggttgcagtgagccaagaatgcgccactgcaccccagtctgggtgacagagcgagactccgtctcaaaacaaacaaacaaaaaggaaacagttcagatgcagctgtaaaaacaaagttaaatccttgccgtccatttacatcagaataaatactagtttgtgctatgggctgaacgtgtcccccaaagttcacgtgttggaaacttaattcccaacgcaacagtgttgaaggtaggacctctaagaggtgtttaggtcacaagggctctgctacatgaatggattaattccgttacagtgggagtggatttgttatctcgggagcaggttactgataaaaggatgggttccgcctccttcagcgctctctcacgtgtgctcctgcccttctgccacctcctgggggatgtagcgacaaagaaggccctcgccagatgtggcccctcaatcctggacttccccatctccaaaattgttagaaataagtctttgtttttcaggaattagccagtctcaggtattctgatacagcagcccaaaatggactaagacagacagattaaatgctgtgtacaaaactaaagtaaaaataccttctagaagaaaagacaggtgcatctttatctggctgcatgctagggagagttgactacacagagagacggaatatctaaaaatggggaaaaatccaacacacttcaccacaaaatatgaaacatttttgacatcaaaatgatcataaacaaaaactaaaagggtgagaaaaatgtgcagtaggcagaaagaggagtgaagaattaatatctttaatatacaaagactcatacaatggctgagaaacacatcaaaacccaagagaaggcctgtcataggggccaggcggccgcaggagacgaagccgcaaccccctgcaggcacacggcggctgatggaggaggccaggctggtgctggtctctgagaggacaccactgctggccagctatgggaaacggcagggcatctgtgtccccgccagcccttctcactcaggcctggtctcagcacgcaccaccccatcacaccctcccagctccccctcctaagggagccatgctactcatcaccatcttgtaaccccacagttggccactggttcctctgtgtgttgtggatctcctcaaccaggctgggagctcctcaggggcagggctgggcctgatgtgcctgtgatgcccaggacccagcatgaggctgggtgagtgggtgctgagtgtggtgacacatgggtgtttacatcagcccctgtcccagctgagccctgaggctccctccccagctgcctcccgctgtggacaggaccacaccccagggcccagcagagcaggcagccgcaagccagagcccaggttgcccaagccagagcagagatggcacaaatgccatcacccatcgcaccagtgcccagggcagacatgaaaaaccaatcaccacagcagacaggaataagcaatcaccacattccagatgggcaggataggagatggggaaaggcagagaaagaggcacagagagggccacagagaaacatagagaagaccaagaactggaggggggagggaaaagaagggacaagaaaggagcaagcaacaggagggagagtgagcaagtgtgcctgggcagcctcggacctgcccagccaaccaccctcctgcggaccctgttaccagggctgtcgtttggtgtctggctgacctggcctccctgaagtgtggtgacctacgaggagttaagggcagtgggacagcccctcctgccaccctgagatgccctgtcacctgtgccacaagcaagccaagtaccctgcctgagcttctttgtcccaacccagaagaccctgcatggccaaatggcctgagcagtgacattctcggccagacgctggtcctcccacacagccaggcggcagcagacccagctcccactaggctggcccggccggcagctttccatgcccaaggacttgggaacaggcaaggagtcagtcatcctgtccctcccatctgccctagatccctcagcctaggtcactcaggcatccggaggccatggccttctccctaccacttaggcacagcactggctgggccatgcctccacaatgggcactaattgtcactgagaaaccacagggctgtcagccatgcctcccacagagactgctttttggggggacaggcagatggccagggtggggactggaggaacaagaatggccaggagccattctcttaagccatcacccactctgctgaacagcacccatcgtggcaaaactctggcagcgtggatgtgagcagggtatgccttaccatccttcagagggtcctgggggacatggaccactcagcctccaaccctgccatgcttcccaggcgctatgcctcagtcccactggagctagcagccatgataagcagaggaaccccaaacacagataacacctgaggccacgggccagtacacatggcctacggctgtgatcagagtacattcagactattcagttatgggctgtctgcagccattttcatcctacaatggcagagaactgcagctgtgacagagaccataaggcctgcaaaattgaattacttactatcagaccttttcaaacaaagttttgtgtgcctggcctccaggactatcctctgtccctgtggctccagtctctggggggcaagcgaatggcctggcccagcaggctgtgccaatactggatgccactgcggctggcatcctagctcaggcaggtgaagagcagacccagtgaatgtccaaaccaacactgaccagcaacctcgtcagccagccccaaacaggcttgtccctaaagccagacatcaaaccagtggctgctgcccatattcaggccagtaacaaacccaagctggtggcaggaggccctcacatccaccctgtccagcccaggggctgtgcctacccagggtgagaaggaccaggagcacacagtgtccagggccagtccatccctgtcacccccacccgccaggcccaccagaacactctgctgtcctatgtgggagaggatgtccccaagctaaacccaggccactcacctgtcttgagggaagatcagcatgtcccgacacccaccctgcaggctctggctcctgcagggaaaccagagggcatgagtgaggtcaatccagctgggtaggtccctgccggataaaggtacacaagcccagaccgtcctctaagcaggaccttgtcatgcctgatctgaaggtcatcccgtggtgctcctgactcataaccacacactcatgtgtaccttcttgcccccacatgtccaggactgtaggtgacactgggctgccacggttccttgtcagcatgtctaatgctgttgaccatccttcagaaacgtgatccttcagagatgtggactgataatgacgtcttccccatcacacacagcacagcagtattcccaccccagggtagccaggctcagggtcctgttgccccacgcaggtgctcacagccccataagacatctgctccacctccctagagtccgctcccgccttgtgggcgaggccacgtgcctctcctgaggttccctgaggccaacatagatcctgggccctcccaggcaggcagctgcccccaacagtctccagtacagggagggcggggaagcaggcaggttcctggccctggagctgtggccaggtgtgaataaccatttgtctgggatgggggacctggcactcaagcctggggagctgaggcttatgggctggagcaggagacaagggggtgcctgtactcacacagctttcagccttcctcaggggaggaccctgcggcttcctgtctcagctaatggccccggggacacattccctctccttatatctaggcccggggatattgccagagtgttcatgtcataaaaatgaaaaacaggacactgcagacagacagggaagggctgggcctcggatgggaggctgtctctgggggacatcggtaatgagagctctctcccccgcctctacggtgttttctagattgttctgaggccccgcccaatagtcctttgtggtcatggtccattctggtgccccaacggtgtgtttccccgtctcacgacagcctcttcatcatgggaaggggtccaagtgagggtgggcgactggctacgcctcagggtgggatcatggggggtgggatgcagggcctgaggcagggaagaactggggaccaagccaggcacatgtgcatatgcatgtgcgtgcatgtgaatatgagtgtgtgtgtgcacctgagatgggcaggcccggttgggagcccatccaccagcactgcgccccgaggaagaggagatgctgctcctactccaaggtctgaggcttaggaaccagcttttgctctgagtgtgacatttctaggaaacctctggttttagcttaagtgttcacataggttttgtaccacagagaaccatgtgactttttttttttatccctgataagcaccagcctctcccccggagtcaccatgtgccacagaaccgagacacactggctgtgagccgtcatctcactgactctaccaggtgtctcaggttggctatataccccattttacacatggagaaactgggtcccagccagacaagggctgggccaggatttaactcaggtcttcctgcctccaggcctcccaaagtcccccccccccacccagttggggaagtgtgaccaaaggagaacatgggtccttcctcatgggcctcctacctcatggggtccagccaggccaagaacctgcaaccatatggtagagccaatagcagaccctgggaaggggtccaagtgaggcattggagagggcttcccccaggagatgggtgggagcagaggatagcagcaccacaggaggctgagtggtaggagcagccagagctgtgggtatccttcctaagggtgcactaggcacatcagcatcgtacaggcaggggcagagcagagcatctgtggacaacctaagggagctctgggcagtggacggacagagggacgacagacaggacagtgatgtgaaggcagaactagtgataggatcatatgggaaggtggggaggtgctcaccttggggagcccccctgagtgctctgcaagctctggggtcacctgcctggccaaggacccagtaccagccgcctcaaagcgggggaatgaccacgccctttattgggcccttttcccagtgaggatggcctgggcctacccatgccatgggacccccacactgggtctccccaccaaactgtccagacccgatggctggccatggggctctgtcagcccctggctacaccccactgatgccctagtaagccctgtggttctggcacggtatccatggtccaaccagagggctgagaggtctcacactggggcataagcctggcccaggccacacagccagattggcaagctacagtcctttggatagctgacggcacagggcagctcccatgggtacacactgggcccagaactgggatggaggatgcagcctgggctgggtaggcaatgaggggcccaggtgagctcgctctgcactccctgcagtgtggcctcagcaggccaccccctccccaagtctcctcgcttcctgctctatgagcgcgaggtgacactgactgtaggtagctgagaacatgccctggcaacagccaatgcaggcaggtgaatggagtgccccgtggccagtggacagggaaggtccatgctgctcaatgacaatgctgtccactacagcaaaaccgagtgttctcctaggcctgctgccaccctgggcacatagtgagaacacgcccacttctgctgtggacattgaggcacagaccacacctgggaaggcttgggaggcccctgggcacacacttgaaggacactgcacttttggggctacgcaggcacagggctagtccttcactgtccctgctgagcctgtgtgtggtcacccaccagctggccttcaggcttccttctgcctgcaccaagcatgttgggggtaccgaggggccttgcttggctcctttccaactccacgccctcaataggcggcttggaggccgagctccggtcatccaagccaggtgtctggggaagggtcctggtctgccgcaggaagctgggtggagccggtcttgcctgctgtggcggtcccagctgccctctggtggccatgctcagctccccgttgctctgccagaggcggcagcccctcaatcagcaggggcagtgggaagggcctgtgcataactggttatggagtggggggaactctgtggccccaggcacccaccagctctgggtcatcttcccgacctgaaacaggccaagatatgaaggccctgagccaggaaaacctactaagggatccctgatcccaagtcccctcagagtgacccaagacttcatcttgggtttttctgtttgtttttttgtgggtatttttttttctttttttgagacggagtctcaccctgtcacccaggctggagtgcgatggcacaatcttggctcactgcaacctctgcctcccaggttcaggcaaccctcctgcctcagtctccccagcagctgggattacaggcatatgccaccaggtccagctaatttgttttgtatttttagtagaaacagggtttcaccatgttggccaggctggtctcaaactcctgacctcaggtgatctgtctgcctgcctcggcctcccaaagtgctgggattacaggtacgagccaccgtgaccagcccatcctggttgttttgtttgtttttgttttttggagatagagtctcgctctatcacccaggctggagtgcagtggtgtgatcttggctcactgcaaccctcacctccccggttcaagcgattctcctgcctcagcctcttgagtagctgggactacaggcgcatgccaccatgcccgactaatttttgtatttttagtagagacagggtttcaccatgttggccaggctagtgtcaaactcctgacctcaggtgatccacctgccttggcctcccaaagtgttgggattacaggcatgagccactgcgcccggcctcattctggtcttaattgaagctgctgacaaaagaacagacacctccccatgactaagccaccatcagggaagtccccaggacccccaaggcccagctggtgctctgcagtgctgtccctggacccccaccctccattcctggccctgtctacagaatgggccctgactccctatcccagctctaccctgtcactccctctgccagggccaggcggggagcacgacagatgggctggacagagggtggtgcctggcatccgtgtgcagagctccctgctccacccagagaccggggatcctgctgctcctgcaccttctgtccttactcaggacagcctcatgctcccccaggccagactcctggggtgaaggagcacagggaactcaccctgaatccctgtgtagcacaaacagaaggaggggtgctaccctaccctcacagagccacagagatgcagagggccccgggactggggggagactacagggccacctctggagggagtgccagagcaaacatgggagccaagcagcccagatgtggtgggtggggagactcaaatttagcaggattgagggtcagaacttgttctcccaggaggaaccttggtcagaaggtccttgtgtttatgctgaaaagcctgacagggcagctcagccaagagctgggcaggggctggcttggctgtgctcaactaccctctcagctgggacttgagtcccttagcgaatgttctgtgcccagtcctctgctgggcgctggtggaccccagaatgggggtagggtggggacaggggacagctgggagcagacattgcggataggatggggcaagactgggggaaatgccttcccagacacgctgcggctcacactgtcgcctgatctaaggcctggatcacctgcttaggagctgaccggccactggcatggcacaccgggcaagagagcgctgactgcccccctgcattcagcaccatcccagctccaatagagtgagtacaagataggtaacacctgccttgtttggaccagacctctaaacaccgcccagatcccagagtaaaggcagataaggcagtagttaagaagtaggaagaagtaaaggcagctaccccagagaagctaaggtcgggagaggtggaggctcccactgcacccccctggcccataccataggggaggtttcccccacagcagcctgggtactcacctgaggttattagacagcagcattaagagcctactctaaaaaatacccacggggcacctttcttttccttatttctaaatatgcctggatgtagggaaagggagctgaagtcctttagttccattttaagtatgttacattacacatagctaagaaacggtgaaatattgtaagcagccaatatttaattatttaaaaattaaaataggctggagctctcaggccacctgcccagggcgactccccagcaaaccgagcagtctccctcagagtggagatgacatgtctccgcaccggcaccgagggggcgcagggcggcgtggggagggggacccaggccgggggtccgggtggcgcgccctctctcacccccgaggcggcaggagcagcgcggcgcgaggacacctccgggccgtcggtgcccctgagcttcccggcggcgcgctgccccaggaaagttcccggcctgccgcccctcgggctgttggaaagtttcggcggctgcagggccctggcagctaggcgccaagcgtcgcgcggggcgggcacggctgcggggtcgggccgcgctcggctggagtgctcagtgcaagacgcccggacgggtagggtagggccccaaggccacgcacaaagagacccgcccccgccggcccggggtctcggacgccgcagagcgcgcggacaagacgcgggtggggcggagattggctccgacgtccggcccagaccctcgcccggatctcgactccagggataggaccctgtccggaccgctgcccggaatgcgtcccatatctgcagccccgcccccagtcccggctccgacccgaggccccagccccgggtcccacaccccgcccactggctcaggcttacctggagcgcagcgtgggcggccccgcagcgcggcctcggaccccagaagggcttccccgggtccgttggcgcgcggggagcggcgttcccagggcgcggcgcggtgcggcgcggcgcgggtcgcagtccacgcggccgcaactcggaccggtgcgggggccgccccctccctccaggcccagcgcgcaacccgagaccccgggccagccctcccgccctcacgcggcccgtgcgcaaagcggaccgggccggcgacgcgaatctccgccccgccccatctgacagcaaattttcccattggtcgagagacccggcgcggcacggcaaccggcgccgattgggcggatgcgcggagatgacggcttgccattgggcctccgggatgtcagtcccggcggatgaccggccccctcgcggaggggccgcggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacaggtatccttcttcagcgcctgctactcgctgcgcgctgcgcgccgctccctcctgtcgacatcgaattgtattcttcacgcaagccgcgagagagagttctgctgctatccccattttacagttgggaaacagcctcagagaggttctcacttgcttgaacacagtcgtctgaccctggggcctgggggctctctcatcctcacgcccctgggtccccgcagcggggagacgatggaggtaggagctgcagtatttccgagggcaggaagggaccccctcggtaaaccaggggctcacctcccccaccaggcctggatgtagagacctcttgggcttgtcccaccctgcaggccccccatggggccgccctttcttacctcctcctggcattctcacagccccacagctctgcgtctggggaggcagagttgtgcgtttatgcccgcaccccgtactactgtcccattttcttcaccctacctggagtcaggaagaaacggtgcttcactgcctgttgagattcacgtaggttacatttccttgccagattaagagcacctgacatgagtgggaccatgaccctccgccagctctgcgtaaccttgtggtgtaggggggaaccagcagggatgctgcccagtgggcttttctagggggaggtcctgagatgacttcttagccagtgaccctggctcacgcatgctgtcatcctttcctgccctggatgcacctggagatgaccagttcctcggctcattgcattctccaaggccgcctggggaaccaaactgcccacaaccatgcttatgagtggtggaggggtgtgaccagacactcttgtcttatccacccatattgggagtccagtgtgttcatccaatcattccttggccaggacaaagaaaatgaaatggcccaaggcaagaactcactgctgggaccaccgctgggtccatctgtgtgctggcagcatggtgaatcgatcccagctgcctttcagagccaggcagctactatcaatcgattggagctggcacttgacgtgccaattggcctcctggcatagggttgttgcttgctgctctgggagggcagaatgaagtagctgtccctagaataggggccctcacaaaccaggtagctgtcatcctgtggagcagcaccatggtgacattctggctcaggtgctgtgtagctgaggggtcgtttcctccatttaggagtagacgtaatgagtccagctgtccccagccatctcttcaaggccattggaccctggttctgctggagcccctcttctcacagttacctcatagtcctgcaccaccccctccccacacttgcaagagggactggacagacctctgttgaaagagtgcaaaagacagaaccatacaccaaaatctgtgcaagtgagactacctctcctctcatcaccacccctaccacccatagggttgcagagacctgtctgccctcggcaggcaggatcattagctgaggtcagaggatgtcggggcagcaccaattcaaacaggactcaggaccgctgtccagcagtcggcccattaggctgcagccaggggtcagaaacacaacaagggaggctgggcgcagtggctcatgcctgtaatcccagcactttgggaggccaaggcaggcaaatcaccagaggtcaggagttcgagaccagcctggccaacatagcaaaaccccatctctactaaaagaatacaaaaaaaagtagcggggcatggtggtagacgcccatagtcccagctacttgggaggctgaggcaggagatcgcttgaacctgggaggcggaggttgcagtgagctgaaattgcaccaccgcacggcagcctaggagacagagcgagactccatctcaaaaaaaaggaaaaaagaaaaagataagaaaaacacagcaagggagaccacagggaccagtagcccagtgttctccctctctcatcctctcacctagctccatgcggacagctgtgaggcccccggagaaagccacagagagaaaatgctttcagctgggtgtcaagaacttttcaagagtggcagctgttgaaatcaaaagagtggccacagaaggtagtgagcttcctatctgagtttgtgtgcaattagaggttggatgccagtgagcctgttgcagccccaagatcccagggcttaggtgcccatcctagacccatttcatctgccgtcacctgcttcctggcatcgcatgtcatccagactggagtgtcagtggtgacaaagaagatcagagtgtctgctctggctctgtctagctgggaaaagtatggctgggggtggggatggcccaaggccacaaggtatgacagaacaggatgcaaaccaccatctgacatgttactgcatccctctttgtgggcaaagggaaaccttggtcaactcatgtccagctttgaggtgcatggcctggtgctttggggaagcccattctccaggtgctgccatgaaccccagggcacagtccatcacccccaagccccagatcccacttgtccaccaccaccacctcttggccctatagattgcataggtttggctgctcagagggaaatcactggtaccagccccacatgatcccactgctggatggtgggagagacaaccatgtctggctgggtctgcggcccgctggccatgagtccctgggcatctggagtccttgtaaaaggttctgttgggttccaggggaaacacagataagatagcaaaagtgtggagcacaacgggcccgcatgtaggtccaggttagactcttgccgttgctgattaccagccaggctcttcccatccctgagccccagttttctgcagggcatcagggcacctaggtcttcaacacaggttgaagctaatgtggcctctcttgcttgccacctttttcaacttcaactgaatgacataactgctccaagtctcagtgtttacatctataaagtgggatgaaagaactgctgacccagacattgggtttagagtgctttacacattatcattatccctaatgtctttgtcatccatgtcatagttttttgaatgctcactttgaggcagggcctgagcctctgggctttgactctccacctttctgccacataggcccaggcacagcccagaggctacaggagcagcggtcccagctaatgcctctgtcctgttgggagggccccagtcagtgcccacctgctcaccctgcacaagtcaagctgggccagcccctcgtcgctggggcctggacctggatgtgagctcaaaggctacactggggggtggaagtgggggaggtggtgggtgtgcagggtatagtgctcaaatgcctagtccagggtctgggggtacatactgggaatggcagggacatcagggaggaaagagccgacctggaggccataaagtgaaggaagggatgaccaagaggaagatggccaggtccagaggtggggttgagtgaacaggatggggagaccaggacgcagtctgagggggccagtccggaagtgagcattcctgtacctcttccgagagaggccgcagggtgagcaggtgacagatggtgtccatgagggcatggactcaggggcggctgcgacctcccatggcgtccctgcaggcagggagccgcggagtccccgaaggccgctggatcaggaagcgctcagacgcccgcgcagcccgaagctttggcgcagccccgggggcggggcgccaggaggtggcagcctccgagcgacagcgcgcccagccaacgggacgccggcatgcggcgcgccgccccgcccctcgctgcgcggcccaatggtgaacgcgccggcttcgggctgggcggtactgggctggctgcggtggcgcgcgggcgcggcacccggaagtcggcggcggtggcggaggcggtgagtgcgcggctccggggctggccgactccgctagtggcccggccggcctgggctcgggggctccgggctctgggctctgggtgcgcggaccgggccaggctgcttgaaggtgggtgggctggccgcacttcctcaccctgcctcagtttcccctttctgaggtatggtatagaatcaggcggctgggtcaggggcaaccacgtcgatcccggccgacgaaaatgccccgcgcgttactggaaggtgtttttgataatccccgctggcacgggatgcgagggactctggcaggtgggaccagactcgctgcggggaggctgagatcggcagggttgggagctgcgtggtccctgcagggtgtgtgggctgctcggccttggccagcatcagggacagctctggcgcccggtcactctgccccctacccgcggcctgctgcgggccagcagggtgacagctaatgtgggtgtgagtagatagtaagtgctgggtcatccctgcgcctggatgcggccttcctggggaggtttgggtagttagatcccccacccccaactccagagcgtcagaggtaggggctggcagggctgcactcagggcagtccttgccccaccgctgggctttgtagcagcctgggctttgcccgttttcctctaggaagtgggcacagagggctgtttgctgagacccccaccttccctgcccctagcacctctcctgtgctcccttggcttcctgctggaccacaagctttagagtgaaccgtctgcccttggacaagtccctgggcctcaggcccccttcctcttcaggaatgtcacatgccctgccctggccaggcctgtttgcactgtcgtgtggctctagacctgctgaccactgttttgctgccactctgggcacagtgccctcttccatgaggcagatgtgacggcagctataagggggtagctgagtagctctttggaaggctttctcacgctagctcatttgcctctgggcagccttttggggcaagcattcattgatccagtcctgctcatacaaggaaaactcaggctaaggtggcagatcgtgttcccaaggtcattcagagccagggcctgctcccagtgcctctactactcctgggccactctcttaggagtgtccctgtgtctgtgtcctgcgtctgtgttgggtgggctgggagcagctggagagggtgaccatgttgttagatggacacagcagagcctctgttcccacaggatcctagtgctctggtggtccagggtagggtgccctggtgcccccaccccctttgacccctacacagctttgtgttacttgcatgtcctcagactgcaggcccctcagaccaagcccctgcctgctgtgatgtgtggtggccatagcccttccctgagctaaggtgaccagctgtcagctcttcctgggctgcccagcctcttgtgcttccttggtcttcacttgtgggctgtcattctgattacgttttgcagtgtgtggaatcacgtgcagtgtcctgggaacttgatcctgtgcccggcttctgcgccagacggcgaacttggagggcaccccggtgcccacccaagggtgctgcttctgaaaacacccacagggatatgaggggcttctcagggaccccagaaggggtctggagagaaatggcccgggatagggaggctgggaagacttctcgaagtagggccatgcttgtcattgacactccagatgcatgagaagcagggcccatcctttggtgacgtgtcagtcagcacatggcagcagcatggcagagcctggcctttgttggcccctaccatagggcttgggctgtcttgaaaacaagcctatccctaccatgaggatgggctccgtgaaaacaaggtcaccccagaaagactgagctgctttttgaggttatcacagctttttcccctttttctctcaacttcccttttagactgcaaaaatagtttatgcatgcttaaagataaaaaaggctggcctccttctcccagcggctgctcccctggtgcacttgctgacatttgggggtacatccattgagatcttcagtgccatgctaacttgaaacttgaagtgcttgccttcatcctctttgcgggcatggtaggagtgcccccctttttttttgtttttactaaccactcaggccgcaggggccgctgcgaggctggcctgtccctggcttgtgaggaagctgagtgttcctcccaggagggcctgaggatggggccaccctgtgtccagagcttgctgtctgctcacgatgcctcttgtttgtgctattccttggaactgggaagagacagtgatcctctggtgtgaggctgaagaaatgccccggaagcattgtgaagatctgaggagagagtaccactgtagaaaatgtgtcatgataggccaagcacggtggctcacgcctgtaatcccagcagtttgggaggccgaggcgggtggatcacgaggccaggagatcgagaccatcctggctaacacggtgaaaccccgtctctactaaaaatacaaaaaaattagccggacgtggtggtggcaggcacctgtagtcccagctactcgggaggctgaggcaggagaatggcgtgaacccaggaggcagagcttgcagtgagccgggatcgtgccactgcactccagcctgggcaacagagcgaaactccatctcaaaaaaaaaaaaagaaaatgtgtcataataaaatgccatttaggcccggcacggtggctcacacctataatcccagcactttgggaggccgagacaggtggatcacctgaggtcaggagttcgagatcagcctggccaacatagtgaaaccccgtccctactaaaaacaaaatacaaaaatttgctgggcatggtggcaggtgcctgtaatcccaactactcgaaaggctgaggcaggagaattgcttgaacccaggaggcgaacgttgcagtgagagaggtcaccctctccagctgcccccagcccacccaacaggaccattgcactccagcctgggcgacaagagcaaaactccatctaaaaataaaaataaaaaatgccatttaatagccagagagtgtaaactggtgagctcttgctgcggagataggagggagcagggcattgcagtggactggagactcagagggtttcctgacgtcaggactttcttcgcccaggccccgtgaacagcgacactgtgttcccacgtgtgtttacctcctctgctgacagccaccgggagcccgcgtcacatgtctgtgtctgcctttgaaaagagcaactcgtgctttcaagctctgcccctgggggctgccaccgctgatggagtggggattacaagggatggggattgggcgcccggctgctcagccctgcagcaccagcccttgtggccattgaggccattaaatgggggcagcagactgtagggcttagtcaccctctgttcagggactcaccatgtgcagccccaataggagcccgacttgatggctaccctcccaagtgtctaggtccccttgaccctgtggtactaatagcttgccattcctctgtcaccactgctttctgcttagcacacatcccctctgcccatgtgctatgcttgccttttcgcttgccaaagggaagtggttccgccaaaagcgtgtgtcccatcccctctggcccccagggtctccaggtgtggtgttgctgcgacagcccagctacaccccgtcctatgcagagctgtcttgcaccagggctgattgggtcttctcttgctttctgtgaacaagtgactcttgggttcttgcccttccttccctctcttccctgcccatagaaatgtcccagccctggcagggaaggagggcaggatctgtacattttctttttttttgcgttttgagacagagtcttgctttgtcacctcaaaaggctgaggcaggagaatcgcttgaataccggaggcagaggttgcagtgacctgagatcgtgccactgcaacctctgcctctcaggttcaatgcgattctcctgcctcagcctcctgagtagctgggattacaggcgtgcatcaccacgccctgctaatttttgtgtttttagtagagacggggtttcaccattttagccaggctggtcttgaactcctgacctcaggtgatccacccacctcggcctcccaaagtgttgggattacaggtgtgagccactgtgcctggccagtgcactttcttttgagggtagacattactgttccccgccgggaagcatgcttactgggtgtgcacgctttcagtgtctggcgtgacagattgtacaaagtgaacccagccacacagctaccgtccatatcacaccaccaccagcacccagatatctccctcgtgtcccccagtggctgcctagaccaggtggccctgccctgcctcctgtccccatgggcagatgttgcttatctctggcctctgcatgaaagaccaagcagagtgctatcttctggctgagacctccctgctgcctcatcaccatggaaaggcacaggctggcttcttttccaggttatggactttcttactgtgtcactttgtggacttgggcacctgcagagtgcctggcatggtgagcaggagttggggcatggcgtgatctaggcagggtttggaaggttctttgaatagccaagggggacagtctggagggtgccctccagacacctgagaatgcattgaagctagggtgactactgcagcatcagaggcctggtgacacatttaaggcctcaaggggcccatgtgactagaagtccaggatgtggctgaggtgggccagactggatggccagcggccacctaaggacaattggctgtgcgtttgggaagcatgggtggtccccacctcacagcagtcgcacaggcagacagtgggcagatccaagagcttcaccaaggctgggcggggtggctcacgcctataatcccagcattttgggaggctgaggcggggggatcatgaggtcaggagttcaagaccagcctgaccaacatggtgaaaacctgtctttactaaaaatacaaaaattagccaggcatggtggcacgcacctgtaatgacagttacttgggaggctgaggcaggagaattgcttgaacccagcaggtggaggttgtagtgagctgagatcgcgccgttgaactccagcctgggcgacatagcgagacttcgtctcaaaaaaaaaaaaaaagagcttcaccactgtgcaaccatacaaggtagataagaaaaaggagttctcattttgggacagggagggcctttagcaggacgggacatgactgctgtacagtaatgatgggaaaatcccatgtaatataaggctatttctactagacagcatcacaggcagagctgaaaggcaggggatggctagggagaaaacagttgcaggcctgggacaggcacatggttgcccacatcacaccagctgcactacgggtcagtgagacaaaggcctagcagtcagtacccatgttggtgaattgttggcaagaacatacaggaggtcacaagttgcccagccagtgggggatgcccataaaaccctggcgggaacatttcccacactgcatacaccctggaggcaggtgagtggcaacaggttctggtgctagacgttagcggggacttggccaagtctgtttatctgaaagcgtcacccatggatggagcaattccacctcttgcgtctatcctaggaatgtcctcagctgctctcccactgttgtaaagaaatacctgggactgggtcatttattaaaaaaagaggtttaattggctctcggttctgcaaggtgcacaggaagcatgatcctggcatttgctcagcttctggggaggcctcaggaaacttacaatcatggcagaaggaaaagcaggagccagcacttcacacggctggagcaggaggaagagagagatgggggaggtgccacacacttaaaaccagatctcgtgagaactctatcactgtacagcaccgggggggatggtgttaaactttcatgagaattctgcccccatgatccaatcgcctcccaccaggtcctgcctccaacactgggaattaaattcaacgtgagatttggtggggacacagatccaagccaaatcagcccatgtgcagagcatgtgctagggatggtcgcttgatgggacgaagacaccagccacagctgagaggcagagcagcgggaaagctgggcagtggtgaaccagtggggacatggctctggtggagacagacctcatggccaatcagggagaacggagcaatgggaccctagcgtgttaaccccacagcatacatgtgtctgctcacatgtgtgtgcaagcaggttaagaacactctggcgccacaggcagcccttggctgaggctttttttccttttttttttgagactcagagtcttgccttgtcacccaggctggagtgcagtggtgctatcatagctcactgcagcctcaaactcctgggctcgagcaatccttctgcctcagcctcctgagtagctgggactacagatgcatgtcaccatgctcggctaattttattttattattatttattttattttactttacttttttgaaacggagtctcgcgctgtcacccaggctggagtgaagtggcacaatctcggttcacggcgccctccggctcctgggttcaagtgatcctcctgcctcagcctcctgagtagctgggattacaggcctgcactaccatgcctggctaatttttgtatttttagtagagaccgggtttcaccgtgttggccaggctggtcttgaattcctgacctcaaatgatctgcccgcctcagcctcccaaagtgcagggattacagccatgagccactgcaccctaccttattttattatattattagtattatattgagacagagtctccctctgttgctgtgttgcggaagtgcagtgacatgatcataattcactgcagccttgatcttctaggctcaagccatcctcctacctcagcctcccaagtagttgggaccacaggcatatgccactgcacctggctaattgtttttatttgctttttgtagacagggacttgctgtgtttcacaggctggacttaaactcctggcctcaaacaatcctcctgctttagcctcccaaagtgctgggatgacagacatgagccctgaagggatggggctttggcccgttaaatgtcactggaaatgtttccctccagaatgtgctcctgggtgacctgagcgatggtattaacaactatgggtcccaccagcctccagagctgccagtcgtggctacaggagactcagccttaggctggggcacagagaggctgaatagagggtgaatgaacaggcagcgtatgggagggaccagcgtttcttggtattatacaaaagctagtggaggtggtgctggttggtgtggggtgggcgactggcacggtcagatgcctgatgcctgttggcctcctcagaaggggaggctggcagtagtgggttctgggacatgcaggagggtggcctggatttgccctgcagcactgaggtctgcctgttccccactgggtcctccatttgaggccctgtcagcatggccctcgtcccccttgcttcttttccccatgggcctctgcaaggttactgcccaccctccaccccacctacctgcctgtggtgggcactgagagccagggaagcagatcctcactgccaggcagcaggccatgtgcgcatccatcagggtgccagaccttgtccccacgcagccctggctggggtcactgctgctgctgctctctgcctgtggctctggcccatctttgcccaggcgttctgtctgaatggttttcttgtcgtgccttttttagacaccgcatggagtgaggtttggggcttgcctcaactggagtctcattcttcttagagagggagtttagcccgtttccatttggccttaggacagaaggccctgttggtttctctgagaagccaggggaggagccctaggctggagaggggattctagagcggggtggctctcagaagcagaaggtgggcagagaggacggtgcacgctgggagagttctcgaaagcatcagcagatgggcccagagtgcctggaaagcttccgtccttcacagacagcgccatgctctaagaataacccatgccaagtccaggctttcttcctgttttgcagaattaccaggttgttaggctaggggaacgtatgctgggattctgggaagaattccacccgcactggtattcttagaggacgggaagcccttggctgcggtgtgaagagggctctctctttccattcatatctcatagatcctctggccaggcttgggggtgttgagggactccaggagtgtggggggaacttcctccctggaagaggcctgtgctctgtccctgctgaggctggtggcatttgcagtcacatggtgagctcacagtgactgtccccctcttacctccctggcagggttggcaaagaccacaccaaagtcccaagtgattagttccccggcctccctgcacagaggctgtgcatgtcccctgggcattcactctagctgtctgggctgcagggaggcagggtgcctggcccaactggagatggcactctactgggggtggttaagtgttgaccatcacaaaggcgacctcttttgtcacatctgtgtgagaggagctggactttctcagatatggatgagcctcacgacgcacatcctttcgtcccttgcttgtctaccaagtccctatgtgctccaggaggcagtggtacaggccagccgctccgtatgaccagagaaccagtgcctcacactccagcgcatttccttcccagggtgcaccaggactcttgtaaagagggcattctcgtgtaagcagttgctttttttttttttttttttaatttttatttttttgagatggagtttccctcttgtctcttaggctggagtgcaatggcacgatctcggttcactgcaacctccacctcgtgggttcaagtgattctcctgcctcagcctcctcagtagctaggattataggcacgcaccaccacacctggctaatttgtttgtttgtttgtttgtttgttttttgagatggagtcttgctctgttgcccaggctggaggacagtggtacgatcttggctcactacaacctctgcctcctgggttcaagcaagtcttctgtctcagcctcccaagtagctgggactacaggcgcccgccaccacgcccggctaatttttgtatttttagtagagacagggtttcaccatattggccaggctggtctcgaactcttgacctcgtgatccacccaccttggcctcccaaagtgctggaattacaggcgtgataatttttgtatttttagtaaagatggggtttcaccatgttggccaggctggcctcaaactcctgacctcaggtgatccacccgccttggcttcccaaagtgttgggattacaggcgtgagccacctcgcccaaccagcagttgctgtaaaattttttaaaaggatgtcacttatactacccagtcattaagacttcctgaggtggaaagatcacttcagcccatgagtttgagaatagcctgggcaacataatgagaccccacctctccaaaaaaatttaaaaattagggccaggcgtggtggctcatgtctgtaataccagcactttgggaggccaaggtgggtgggtcacaaggtcaggagatcgagaccatcctggccaacatggtgaaaccccatctctactaaaaatacaaaaattagctgggtgtgatggcacgcacctctagtcccagctatttgagaggctgaggcaggagaatcgcttgaaccagggaggaggaggctgcagtgagctgagatcgcgccgctgcactccagcctaggtgacagatcgagactctgtctcaaaaaaaaaaaattagccgggtgtggtggtatgcagctgtaatcttagctacttgggaggctgaggtgggaggatggcttgagcccaggagttcgaggctgcagtgagctatgatcacacgactgcacctgggcgacagagtggaggtgatgtgcttcctcaaatagccatgagaacaacgcttcttttcttgtcctggctcaggaacctcaccaccatgccacgttgccctgctgcgctgtgctggtgtcgtaggtcggtggcaggacatttgcccacctcacaggctctgctttcagtcttgaagtatggctcctctcgactgctgcccacacggcctcctgttgtcagcctgggctacatatctgggctcttccatccctgtgggcctggtgaggcctggccatgtgcctgtgtcatgccagttgctttcaagatgatgtttctagtaggaccacatgtgaacacagtgaccaccatggccaggaggaagctggctgcccatcaccagcttgcccagggacctcttgcaccctggcggggatcagcagatcctgctatgagagagcagaaggcagcatgctgacttccaggagtgtccacagcgtggctgggcagagcagagctacaaatgaacagatccagtgccgaggccatcctgactctctcaggggctgccaggccgtgggtgcagggtccagcaggcccacttgatcccagcatcccacgtgtgcctgctcggggtggccagctcactgcttcttcacctctagcccaaccagcaggtgccccaccatgagcccctccaggctcaccttgcccatccctgccatgtgacctgggactcttgagatgagatcacagctgcagagcacacagcacagggaggagctcatcagcatcttcccacctgtggtgccctggcccagcctccttccggttggggttggacccgccctggcagccaggttttgcgtcacctgccccacccgccctgtaacctacttgcccaactgctatcccggtggccgtgaggccagttgacagaatggagaggggtaagcattttccgcctggagaggatgggcgtgtggccatctgactgcttctgcaagcctggtggttgtgtgcaggctgccctggtggtcttagccccttggggcaggcggggtcctgtgcaggatgcagagactgggcgtggcttcctgcagatgttcagatgcttctgggctgtggcctctgagacccagggcaaggctgctgactggaccccagaccctcctgcctgcctcttcctccagctgctctttgtggtctggttctggccgcctgggcctcagggccaaccctgcatggctttgaccactctggccttcttggactgccaaggacatgctgagagttggttgggcttggcccaagtgctgagcccagggcaggggtggggacaggcagggcggagcctcacctggaaagccaggcacgattctccctgggacaccaaccctcctgtagagttggccaattcgggcaaccttgagggcgagctctgtgtggcacaagagatgccctgaggagcccagcctcacctggtgtgatgggacctgtggaagttgtgggaagtggtcctggccacccgtgtgcccacatgccctgcgcccagatcaagatatggtgaccaaaaggacaaggactatatccatggctccctcccagagcctggcaagtcagcaggcatgagagggtgttggaatgctgtggtgggcctgtgtggggaccttgtaggacctagggaacctgcagggcttggcttagggagcacacaggggcccaggcaaaggcaaggtcacaggtcgggggaggtgaagctggcagggggagggggagacctgctggctagagctgggttgggggccggtgggcagtgggcctggctcgagcagggggcgagggattggagagaaaggcagttcctgatggtcccctccccaggggctggctttcctctggtccttccctcccaatgaccgcgtcttcgtcgaggccacagcccttggctctgcgcccacacctccagtgccaggctgtccggagatctgtttatggccttcccttggaccatggagccctccctgccactggtgcctggagggctggtctgctgcccctgcaccctggccagctaggatggtggggtcctgcagctgaactgggggtgcctttctgcctgtctgtcctacgtgtatcagtggccagaactgccctcatccatggccttgccagcagctgggcgtgcagcccagggagggctgaggtcggctgaagttgattgagaccaacggccttctctaacaccccagaggagcatgtccctggtgagcaggccttgggcagccctgggctccaggccagtgggattccagtagagaccagctggcagggcttctccagtgactgcagccaggggttctcatgtgcaggaaagaccagctcctccagagtaaagggacttgtgtcttctggccacatggtgagtgctgggcccaccccatcagtggcaccttgggtgcactcccaaagcccagcgtgttccccatcttcctgcactgcattcgggatggttctgcatcatcagctgcacctgattgctcttaaacccacagctgagctttaatgtgcagtcactgaagctttcatttctaaaatagcttcctaagagttcttttggccaggcatggtggctcatgcctgtaatcctaacactttgggaggccgaggtgggtggatcacctgaggtcaggagttggagaccagcctgaccaacatggagaaaccccgtctccactaaaaatacaaaattagctgggcgtggtggcgcatgcctgtaatcccagctactcgggaggctgaggcaggagaattgcttgaactcggggggcggaggttgcggtgagccgagattatgccagccagcctgggcaacaggagcaaaaacaaaacaacaacaacaaaaaaaaaccgagttccttttgctgctttgtaaacccagtttgctcttcatcacttcctttgccctgcagatgtttctgagctgtctgttttctttctgccatcagagcatggttggttgatgatgcatgtacggttatctttctgctggttcttgctcatggtgcttctttcattatgtggttctttctgactatgtactgcttctggtctttgaaaaatgattttgagacttctttgaagtataggatgaaggtatctttctccagagagaacttcaggcacaggggcactacgagtgctggaaccccttaaaactgtgcttggcttgtgggtccttgtacccccagtgtggacctggacggctggctgtgccacagcttctcagaaacttcccttcacttatgtgcaatgtccccataacccctgggggtggctgcggctgtagttcatctctccctaagcatcgctctttggagtcccagcctaacttagaggagagtcttctgttaggttcttcatcctgtgggggtgactggaccttgtcttctgtctccttcgcccccgaggccaccagagtatgagccccagtgtgttcagtgggcaaacgctctcaggcaggattggccactgtgttctgctgtcctctgtgggccacgctctccgaactgttggccaaatgctgcatgagctcatcagctcctggcaatttttaagatgttttcatatttcatccagcatcttgagttgtttttaccaaaaggattgcccctagtagcctgcccaccctcggatgatggccccctgtgggcgcttccagggcacccggcaaggggacccaacccacttccagccccacagtctgcttcccacagggcccccttgcaacaacacaccctttagcttcccatcctatgcagagtggtggccagcagaccatctcaaatggctgcccatccccctgacccagtgcgtctgcacgtggcgcttattgctatcccaatacttcaactgcacagccaccagctcctcactggagcagatggtccccaatggccatccctaatgcccgtgcctatggaggcacatacactgagccctcttcacctccgtccccactcattagacttttctcagaggaatctttttgggtctcttcagtatttgaacagcttcttggctgtcccatgtcccagctgtgagcactggctctgccctggagccgtgtcactaaatcattgcacatgtgcacatttcagggaacttgggtgtcacccttgggtggcctcggaatctaatctccgttctgcactcgtttgcattgtggaaaactgcctgctctgggccccagaggtccctgggtggggacgaggtgtatgctaagtgtgcagtcacccagcgtgtccccggcacgtgtccatgccagctgctgtgggtgtgtggggccttcgggtcctgtgggatggcgagtgtgtgtgctgagcaggacctgtagggcctgcatcccaggtgagtgggccatgctgttggaggcggaggcagggctgcccccactggtggcgtgtggggtgggtttggtgctgttgcaggggaggagatgtgcatgtgggggacagtcttgaaggaagaatgtatacagtggtctatttccaagacaaagtgtcttaaattggcttagctcagcaaactacagaagaaacaggatatactaggccaccctgcttggatagctgatgtgtgcttgtcggcctccactttccccgcacttagttgccttcacccgaaccaaagaagttcagtctaagctgaaagtttactagcctgcaaaatagctcattttgtctgttcttatcagcctgcctgctacttaggtcgtaagttaaatacttaaaaagtccctgagctaactaggactgcaatgcattgtgggctgcaacaaaatacagcaagacaagcccccaaaaaaacacctgaagcccctacccaacaattaataggcgacgtccgggaaaattgtgaccccacagtactcggcctatgaggaactgggggagggacctgcgtactaggggataaattgcttgtcgaaactgtgctgggtgtgcctgtctgacacctgatcttgcaagactgtcattaaaagtctcactttcgctgttctctgggtctgagttcattctttagatttggatgggtaagtttgtttctcacagtgtggctcctgccctcacttctgctgccccccggggaccccctcggcaccccagctcggtgtgtccaggccttaagactaccatggtgctgatgggatgcttctgttcagggctggtgttgcaggtggtggagagacagtctggccagtgccaatgagtgcatgggtttgggagttgtttgtgtggcaccggccaagagtgtggtgtccagttcccccacacccagcaagtagtacagacaccacagaggtggttctctctgttctggcctgttgcaggttcggagggcagccctgagtgtctgccatccgctcaactcagtgttttccttttcccgcagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggtaggacagaggagtgacatgggtccaggtgggctgcagttctatgggctttgaggagggtcgggcggcagaactgggacaacggcgtcagtgagtgagagccagcttgggctggcgggtcacagctgctggtgagaagtcaaagtggcggccaggctaggggtctgtgggtgggtcctgagctgaggaaaaagaacctggggaagaggggacgctgaggaccagccagaggagtcaggaaatcgaggccagaagccacccctgaccctggactcaggacggccacacctccattccccaggacaccccagcatttatccacacagagaacgaggcagagatataacccacatctaaaatgaaacgtgtaaccactctctaatgcaactgctcgggaagttttcatcattttaaaatctgtaccagaaatgatttgaaccatttcaagagggtctcagatttgagtcactgcaaagttgcatagacaccatgctgcttgacttcaaggctgagtgaagtcatttcaggccaaggaatcaggaaggaagggtgtctggtgttttccctttttgcagttgggtgagtggcaggtcccagcagcagacagcatgctgcagggaaggtggaagaaatgttaggaaagaactattgactgctacagggactggagtagtgttgggctggctagtgagtgaacagaactctaaagaatgtaggggctggccgagcacggtggctcacgcctgtaatcccagcactttgggaggccaaggtgggcggatcacaaggtcaggagatccagaccatcctggataacacatctctactaaaaacacacaaaaaaattagctgggcatgggggtgggcgcctgtagtcccagccacttgggaggctgagacaagagaatggcgtgaacctgggaggcagagcttgcagtgagccgagattgcgccactgcactccagcatgggcaacagagcgagactgcatctcaaaaaaaagatgaaggtaaaataaggtcatgtgggtaggccctaatcaatgtgatgggtgactcagatacgcacaggggaagctggtgtgtatacagagatagaagcagtcgtctgcataccgagaagaccctcaaaaggagccagccctgctgacgccttgatcttggatctccagcatccaatgctgcgagacaatagtgtctgttgttgcagccgcctggtctgtggtgcttagttacggcagccccaggaaactagcacgctgaggagagccagccagctctgtatgcgtttcagggctgcctcctgcaggctgctgaagagactcaacccaccccgagtgctcccatctctggaaaggaagcttgatggctggcctgcgggtgctggtcagtgccacccagccccttgggtggagaggaggagggttgacatgggcccctcttgctttcactcagaacccgtgtgttgctgccaggacctgtcctgcgggtcctgccattccagttggcctcgggatttctctggactattttccgaagccctaagccaaagacgaaatgtgccacctctgggtgactgagcaaatgtgcgctgtgttttcctgacttcatgggagggtgtgagacacttctggtggctgcttctgctctgcctgtggggtgtccagccaggggaagggcacgctgcaggctgggagcacagacacttctatggagcccctgacagcacctctgcagcactttgggaggcctcgtacaggtacccagctaggctgggctggactcctcacctgtggactggagtaaaaagtagggtgctttaggccactatgttttttttttttattattattattattattttagagacaggatcttgctctgttgcccaggctggagtacagtggtatgatcatagcttactgcagcctcaaactcgccggctcaagcgatcctcccacttcagcatgcctaagtaactgggactacaacaccatgcccggctaatttttttttttttggtagagacaagttctcactatgttgtccagggtggtctcgaactcctgggcccaagtgatcctcctgcctcagcctcccaaaatgctgggattacatgcgtgagccaccatgcccggcctcggccactgtatttggtaatttgatacccatcacggaaaaccaagaccctgcagcaagataacacaatcacttcatgatgtcaccctatctctttcaaaactgcctgtttacagccgggtgcggtggctcacgcctgtaatcccagcactttgggaggctgaggtgggtggatcacttgaggtcaggagttcgagaccagcctggccaacatggtgaaaccccatctctactaaaaatacaaaaattagcctggcatggtggcgcacacctgtaatcccagctattagggaggctaaggcaggagaattgcttgagcctgggaggcagaggttacagggaactgagatagcgccactgcactccagcctggatgacagagtgagactccatcttaaaaaaaagaaaaaacgaaaaaaaacctgcctgtttacagccccacgtgatgccacttgctggcttcagcctagagtggctgcaggacaagctgttactccatgggacagcttccatggggtcaccactgagggtttgatcactggatctcaggccagagtacctcctatctgtcaccaaactgtcccccagacagtgcacacactcaccccccggcagaacacactcaccccccgagatgatgcacataccccccggacagtacacgcactcaccctgcctagcagcgtgggtgtcaggtggtgatggataattagtggtttcagttattggaacaaaataaagccgaggtgacttgccatcctcagggacctcaccgtggtgggtgcatccctgtctctctggacgtggggcgcagataggcttctacccatgtgcagccccaccagtgatgactgagagagctacttcctcctccctttggggcttgatctgggtgctcagcatgctggcttgtccctgaattatgtattcaatgaaatccctggcaaaccaccagcaattcagctaaacatgactgctggaacaaaaataacctggcaattaatgttcctgagttattaggcaaacatatataattgctccttgtttaaaaacagacagctgaacatcttaggacaaaagtccatgctcagtcagcttttcttcctacttttctcccctttattttccctttgtaagagcattatgtcagaatcagcacccgaagccaacagccccagcctggtttggggctggactgggatgaggtgtccctggctcccccgacccctgttcacctgcagggctgtgggacgtggaagcagaggaggaaggtatttaagagagaatgctgagcagaaccacatggagcttgaccccacccatagggtggaggagctgtcatcccagaccctggcacatccccaccatagcactcagggactgcggtgttcccccttctcctgcccgctggccaggacacaaccaatgggcacctacaggactggcccatccaggtctggggcaagtgcactgccttctactagcactgtccagcccagggaaggtgggctctcctgccatccctgctgcagaggttggggggcacttctgcccagaagggacatggagacttgggctgggtctgggttgaaacatggcagttagaggtacaaaggctgaggctcatcagggacagagaccacctccccctaccccaggcagcacatccctgagacctggtgcagccctggggccagctgggtgtcagaccaggctgaatggggcaccctggaggtggtaaggcttccatagcagaccccaagggctctagggcatggcacagtccctggcaatgaccaaaagcatttccccagttctgctggcaagaagcttcaggggcaggcactgagtggggggcacacatgtgcacacaggtgtgaatgcctccaagggcatgaatggtgggtgctagcaccatgtacttttttgtttgaaatggagtttcgttctgtcgcccaggctagagtgcagtggcacgatctcagctccctgcaacctccgcctcccgggttcaagcaattctctgcctcaacctctcgagcagctgggattacaggcgcccgccaccacacccggctaattttttttttttttttttgagacggagtcttgctctgtcactcaggctggagtacagtagcatgatctcggctcactgcaaactctgcctcccgggttcacaccattgtcctgcctcagcctcccgagtagctgggactacaggcgcccgccaccacacctggctaattttttgtatttttagtagagacggggttttaccgtgttagccaggatggtctcgatctcttgacctcgtgatcctcccaccttggcctctcaaagtgctgggattacaggcgtgagccaccgggcccggcctaatttttgtatttttaatagagatggggtttcaccatcttggccaggctggtcttgaactcctgacctcatgatccacccacctcggcctcgcaaaatgctgggattacaggcatgagccaccgtacccagctgtgagcaccactttcactcccaattttatgaatgtctgttatttcacatttaatcaggagcaaatgttgttttatgaaattgatgtgcaatgatcaatatggaaattatttttaaacacttgtcgggctctcaccactgcaacttggtttcagactcagattgtgatggcaggacagctgagctctgctccttggagctgcctctccggcacaagtgctcagggggtcttcagccatcactttttttttttttttagagacagggcttctctgttccccaggttggagtgcaatggtgcagtcacagttcactgcagcctcaaactcctgggctcaaatgatcctgctgcctcagcctccccagtagttgggaatacaggcatgcaccaccacacctgactaatttttgtattttttttttgtagatatggggtcttactttcttgcccaagctggtctcaaaactcctagcctcaagtgatcctcccactttggcctcccaaactgctgggattacaggtgtcatccactgtgcctggcccagccatcgcttcttagaccctcaggtctaatggacattgcaggaactgaccccttccactcagtcactgctgtgtccttatttgttttcttctaatgtccaagctgggacttgaaagtcagttttctttcctcaagaccagggctcttaaagtttagatgtctctcctaattccaaaagaaatatttgtttgattaggctggatgtggtggctcacacctgtaatcctccgcctcggaggccgaggcgggtagatcatttgaggtcaggagttcaagaccagcttggccaacatggtgaaaccccatctctactaaaaatacaaaaaattagctgggtgtggtggcgggtgcctgtaatcccagctactcaggaggctgaggcgggagaatagcttgaacccgggaggcgggagttgcagtgagccgatgtcacgccactgcactctagcctgggtgacacagagagactccatctcaaaaaataaaaataaataaaaatggaaatatttgtttgattcataatgcaaaaaaactagtaaaacagtgaagttcccatccactcccaaccaacccgagaaattaactccaaaacacacagaatggagcagccctcagaggcccacatgctgtgccattcaatctgtatccttgagctcacgcttccaagagcccacgggtttgttgtgggtgttcccagggctggggacagatggacagaaggaggaacagccccccaccctccagcctgggctcccggcatggagcccaggctccatggtgcccctaagggcctggcagacccgtctcccgccattgaatggtgtggatgtgtgtccctgcctagcatcctcctgtttcccgtgcggtcccagctgcaggctcccgagagctcacctggagccacggtgctccttcctccagtgtgggtgcagcaggactgccggcttcctgccctctctgagactggcccttgttgccactgaggccagttttgtgtgtgaaaagagaaaaagacttggctcgctcgtttccatctgaagccatcagtgatgctttcctcttgcaggctcatcttggcagccaacagggatgaattctacagccgaccctccaagttagctgacttctgggggaacaacaacgagatcctcagtggtgagtcttcctgcgtgctcagcggtggctgcgccttgttgcttccctagcccctgcgtggcccgagtgaccctaactgagtggtgctgcttccaagtgtgatggcggggtgtagaggtggaactgatggggctcgtggtcggggccagccccagcaccgggcattgccagagctgcccacccagcactgtctgcgtggcttcctgtgccatgcgtctgcatgggggccccatcatgtgaaagcatcagttggttttatatggatccctcctttttgctgagggcatgtgggtggatttgtgtgatgtacagatccacactcagtcactttgtgaagcaacccagtcatatgagtgtgtgcatgcgtgtgtatgcgtgcgtgtgtgtgcctgtgtttgtgtttctgtttgtatatgagcacccttgcttcagggatggtggggctgagtttgggaagctggtggtgctgaagccccgtcacctgcaccatgcctgtgttgcattaggtgtacttatagggcagaagtaggggtgagaaccaggtcctccccaccaaagataccagcctcattgaagtcctgttggacaggaaccagttcctgcccatggggtggtgggagtctacctggaaggtgcgcatagatggctggtgaggccacgggttactctgcctgcgtaccaggcgccaagtgggcccgaggcatcctggcatgctccagggtgcccactcaggccagatgtgtgacctcgtgggcccatggaggctgtgtgtgccctgtgctgcctcccaggccgggagggcaggtgttgggattataggtgtgaacccaacacttaaggaggctgaggcaggaggattacttgagcccaggagttcaagaccagtctgggcaacatggtaaaaccctgtctctacaaaaaaaaatacaaaaattagccaggcgtggtggcatgtgcctgtggccccagctactcaggaggctgaggctagagaattgcctgagcccggaaagcagaggtttcagtgagctgagattgtgccactgcactccagcatgggtgacagagcgagaccctgtctcattcaatcagtcaatcaatcaatcaaataaaagctcagctgtggggttttgtgaggactcctgtgtaggcctgtggcctggcagtagtgtgagaatgctgctgaggctgggtggtcccggcaccgtgtgggaggaggacgggtgcatggagactgaggcagggtggtcctaggcctgctggtataggaggatgcagtgggtgcagggctggtcaggacgggtgggtgaaggcacaagactgatgtccttggaaggtggaaggttttcatagatgaagatgtggcggctcagagggttaccctcttctggttccttgactattgtgccctcctgggctccatcccaccctggcacccaggtctgtcagctgcctctgaactagtgccaaccccagcagctccagtcttgtggaattgttcacccctgtggtgttttgatggtggcagctggtgcatggatgtacacgggcttctgccaagtgtcggggtgaccatatcactaaggcccacatcctctcactctctggcgtcaccggattgtatgcaaaagtttaggacagtggttctccaggtgtggtccttgggcctgtagcaccagctttacttgagaacttgttagaaatgaaatcaccctgggccggtggctcacacctgtaatctcagcactttgggagtccaaggcaggaggatcccttgaggccaggagcttgagaccggcctgggcaacgtagtgagtccctgtctttacaaaaaaaaaaaaaaaaattagccagctgtggtggcatatgcctgttgtcccagttactcaggaggctgaggtgggaggatcgcctgagcctggaaggtagaagctgcagtgaaccgagactgagccactgcagttagcctaggcaacagagtgagaccctgtctgaaaaaaaagaaaagaaatgcaaatcaaaatcattaaattcataaaaatttggccatcacttctttttttttttttttttttttgagatggaattttgctcttgttgcccaggctggagtgcaatggtgccatctcagctcaccgcaacctccatctcccgggttcaagctgttctcctgcttcagccttcctaatagctgggattacaggcatgcaccaccacaccaggctaattttgtatttttagtagagatggggtttctccatgttggtcaggctggccttgaactcccgacctcaggtgatccgcccgccttgtcctcccaaagtgctgggattagaagcatgagccattgcacccagcggccattactttttcaagtagtttttctgtcttctctctcactctctccttctctccagttacacacatatattagttcacttgcccttgtcccacacctctgcgatgctctctgcgtacttttctcggtgcccctagatcttgaggttttccagcctggtgtctgggagccagccctactccctgccctgtgtgagcactggtggttcttgccccagtgtcatatagtctcctccctgagatgctgatcagacattctctgtgtagctccttcctctctggacttttgtgccactgtcttagttcgtttgtgttgctctaaaggaaaaagctgagtctgggtaatttttttctttttttttgagatagggtctcactctgttgcccaggctggagtgcagtggcacaatcctgtctcactgcagcctctaactcctggcctcaagtgatcctcccacctcagcctccctagtagctgggactacaagtgcacatcaccatgcccagctaatttttaaaaataatttgtagcgacaaagccttgctgtgttgcacaagctggtttcaaagtcctggcctgaagtgaccctcctttcttggcctccgaaagtgctgggattacagataataagccatggtgcccagccaaggctgggtaattttttttttttttttttttttgagacagagtcttgctctgtcgcttaggctggagtgcaatggtgcgaccttggctcactgcaacctccacctcccaggttcaagtgattctcctgcctcagcctcctgagtagctgggattacaggcacctgccaccacaccctgctaatttttgtatttttgtatttttttattattattctttaagttctagggtacatgtgcagaacgtgcaggtttgttacataggtatacatacatgtgccatgttggtttgctgcacccatcaactcatcatttacattgggtatttctcctaacgctatccttcccccagcccaatttttgtatttttagtagagatggggtttcaccaggttggctgggctggtctcaaactcctgacctcaagtgatccacaaggctgggtaatttataaagaaaagaggtttatttggcttagagttctacaggggacctgaagcacagtgtcagcatctgcttctgatgcaggcctcaggaagcttctactgatggtggaaggggaaggggaggtggtatgtgcagatcacacacggagggaggaagccagagagagggaggaggcgccacgctcttttaaacaaccagttctcaaaggaactaatagagctagaactcatcactgtgaggacaacaccaagccgttcatgaaggatctgccattaggtagatctgtctcccattagaccccacctccaacactggggatcagttttttggtttgtttgttttttttttttttttttgagacagagtttcactcttgttgcccaggctggagtgcaatggcacgatctcggctcaccacaagctccgcctccaaggttcaagcaattctcctgcctcagcctcctgagtagctgggattacaggcgcctgccaccatgcccagctaattttttgtgtttttagtagagacggggtttcaccatgttggtcaggctggtctcgaactcttgacctcaggcaatccacccgcctcagcctcccaaaatgctgagattagaggcgtgagccacctcacccagcccggggatcagattttaacatgaggtctgggggacaaacatccaaactatggcagccatgaactctggttgtcttagtttccccaaacactaagcccctcttctcagctcagggagtctgctgaattcggcctggtccccccactccctgggctgggtcctggagcctctctaatcatgggctcactttgtttcctgtctgtcatatccttttttgtaaaacccatttgatatggtttggctgtgtctccacccaaatctcatcttgaattatagttccccaaatccccacatgtcctgggagagacccagtgggaggtaattgaatcatggggcattacccccatgctgctattctcatgatagtgagttctcatgagatctgatagtgttttgtttttttttttttgagactgagtttcgctcttgttacccaggctggagtgcaatggtgcgatctcggctcactgcaacctccacctcccaggttcaagcaattctcctgcctcagcctcctgagtagctggaattacagccgcttgccaccacgcccagctaatttttgtatttttagtagagatggggtttcaccatgttggccaggctggtctcgaactcctgacctcaggtgatccgcctgcctcggccttccgaagtgctgacattacaggcatgagctgccgctcccagccaagatctgatggttttataaggggcttttcctgctttgcttggaacttctccttcctgccaccatgtgaagaaggacatgtttgcttccccttctgccatgattgtaagtttcctgaggcctccccagccatgctgaactatgagtcacatatctttcctttataaattacccagtctcgggtatgtccttgtagcagcatgagaatggactaataaatacaccattgtttcttgagttttatttatttatttattttttggttgttttatgcaggagggtaaatctggtccttgttgcttgggcaatttggaagttttgttcttgttttaattattgatttgtaagagttatttacccattctggatatgagtcctttgtgcctactcatttccttaatgatagcttatggtgagcagaattttttttttttcttttgagtgggtggagtcttactctgttgccaggctggagtacagtggtgcgatctcagctcactgcaacctccgcctcccaggttcaagtgattcttctgcctcagcctcctgagtagctgggactacaagcatgcaccaccatgcccagctaatttttgtatttttagtagagatggggtttcaccatgttggccaggatgggctcaatctcttgacctcttgatctgcctgccttggcctcccaaagtggtaggattacaggcgtgagccactgcgcccggccagaatatttcattttaacaaagtacagtttatcttatcttttatgagttgttctttttgtgccttatccaaaaagtctttgcctacccagaggaaaatatataacaatattttcctccatttgcttctagaagcctaatttttgtttttatgtttggtctatgatttatctcaaggttttgtacatggtgtgaggtaggggttgagatttactgcctccaacccccaaatctctctagttgttccagcatcatttattaaatggattatcttttgcctagttcattactatggcaacttggttgtacatcagttgaacatatatgtgtgggtctattcctgactctgttgtatcccattgatctatgtatctgtcttgatgccaacaccatgcagtctatgagtgctgctgctttttagtaagtcttgaaatcaggctgagcactgtggctcacacctgtaatcccagcactttgggagaccgaggtgggcagatcacctgaggttgggagttcaagaccagcctgaccaacatggagaaaccccgtctctactaaaaatacaaaattagctgggtgtggtggtccatgcctgtaatcccagctactcgggaggctgaggcaggagaatcacttgaacccgggaggcggaggttgcggtgagctgagatcacgccattgcactccagcctgggtaacaagagcgaaactctgtctcaaaaaaaaaaaaaaaaagaaaaaagaaatcaggcaatgtgggtctgccttctttttcgggactattttggccatcccagttcctttgcatatgcatagatatttcagccagtctgttaattgctataaaacgaaaagccccctgggattttgactgggcaggttttgaatctatgggtcatgtggggagaagtgtcaccttaacaatactgagttgtctaagaagtacccagtgaaacaaataataacaagaagaaacactgttgaggctgggcacggtggctcacgcctgtaattccagcactttggaaggccgaggcgggccgatcatgagatcaggagaccgagaccatcttggctaacacggtgaaaccctgtctctactaaaaaaatatgaaaaaattagctaggtgtggtggtgggcacctgtagtcccagctacttgggaggctgaggcaggagaatggcctgaacccgggaggcggagcttgcagtgaactgagatcacaccactgcactccagcctaggcgacagagcaagactctaaaaaacaaaaacaaacaaaaaaacactattgaatctttcagtgaatatgcatgtctctccttaaatcaggtcagctcaacttgagaccctcaacagtgccctggagttttcagtctttgtcactcatttttcattaaatattttcctggtggtttttttttttttttttttttttgagacggagtcttggtctgttgcccaggctagagtgcaatggcgccatctctgctcattgcaacctccacctcccgggttccagcaattctcctgtctcagcctcccgagtagctggaactacaggtgcctgccaccatgcccagctaatttttgtatttttagtagagatggggtttcatcatattggccaggctggtctcgaactcctgacctcgtgatccgcccgccttggcctcccaaagtgctgggattacaggcgtgagccactgcacccggcttttttttttttttttaatcacactaaggattttaaaaatgctgttataaatggtatatttaaatgctcactttccagttcttgctagcatttacttattagttctaatacatcggttttggtattccttttgggttttcttcatatatgatcctgctggttgcaaatacagttttgttgggttttttttttttttttgagacagagtttcgctgagagtgcaatggtgtgatctcggctcactgcaacctccacctcccgggttcaagcaattcccctgcctcagccccccgagtagctgggattataggctgcctcagcctcctaagtagttgggattacaggcatgcaccaccacgcctggctaattttgtatctttaatagaaatggtgtttctccatgttggtcaggctggtcttgaactcccaacctcaggtgatctgcccgcctcggcctcccaaagggctgggattacaggtgtgagtcaccgcacggggccacaaatacagttttatttctttatttttgatctttacatcttttctttttctgttataattaattattgttataaaaataatatcttagggccaggcacggtggctcacacctgtaatcccagcactttgggacgccaaggcggacggatcacctgaggttgggaattcgagaccagcctggccaacatggagaaactccgtttctactaaaaatacaaaattagccaggtgtgatggcacatgcctgtaattccagctactcaggaggctgaggcaggagaatcgcttgaacccaggagggagaggttgcagtgagccgagagcacaccattgcactccagcctgggcaacaagagcgaaactctgtctcaaaaagtaataataacaataataaataaaataacatcctagccagtgcagtggctcactcctgtaatcccagcactttgggaggctgagtcgggaggatcgcttgagcccaggagttcgagacaagcctgggcaacacagcaaaactttgtctgtacaaaaaaatgcaaaaatcagccgagtgtgatggtacctgcctgtggtcccagctacttgggctgaggtgggaggatcgcttgagcctgggaggtggaggttgcagtgaactgtgtgattgccactgaactccagcttgggtgacagagtgagactctgtctcaaaaaaataaaaaatgaaataaaataataaaaataacatcttaatgacagccttttttgccccaatctttgggtaaaatgaccccctggtctaagaaggagccctcctgtggctttcagagccctccaaccttgtggcattagcagtggcccatgccctgcagatttggcgggggtgaaggtcctggttgtgtgctgggctcctagtgaagggcctgccctttgggcctggtgcatcctgctgggtgaggacagccagcgtccctgcaccccattcatgcgattggagcctagtgctgcccctcagccttgacgctggcccaagtggaaggatgtgttctgcagggcatctgttgggataggtgtggttggtgtcatagttgtcctgcaggacagggatctcacttgcacgacccatgaaccccaggggctgcctggccttgaagagttccagccacgattccatagctggggctgctgggccaagccgcatgtcgaacgtcctcgaggagcttgaggcaggagctgggccgagtatgcgtctcccagggctgggaaccaggtgggggactggaatgggtggcatcaatggtggtaacactgtcatctgccacagggctggacatggaggaaggcaaggaaggaggcacatggctgggcatcagcacacgtggcaagctggcagcactcaccaactacctgcagccgcagctggactggcaggcccgagggcgaggtaaggcgagtggggtggggccaaggtgagacagggtggggtggggcaggcctaggtgagacaaggtggggccaagggactacaggactggccaatgtatggtggagtggggcgggccaaggtaggaagtgccaaggtgcttgtgcttgggagtgggatggggcagggctgaggtaccgtggggcagggccaggttacagagtgggcggtgacaaagcgtggcagggcagggcccaggtaagggtggggacaagaagggggaagctgggccccgtggcaggtgggtggcttccgtgggcatatcactgccgccactgaggtgtgctgcaggggtatgcggcagagacaggaagagtgaggaggggagcatcccatttcccacaccctggccctctggcgtcgcagccaggagcccactcccacctgacccacgcagcactgtttactcctctcagggcgcactctccccttgtcctcatgcatggcactcctgactgctgtgtcactgtcccctgcctggaatgtttgtagagtagatgccttccccgagacgacagctctgtggacacacattgtccccactgaaaggtgttgtttacttcatgctggatttccataggaagacatagtggggaaattttttttttaataaaatgagcagttttcagtgccgacctgagtggcagccaggctaatgaggtgtggctgactcttgcggcagtcatgacaggccagggctccagtgggacccctcatcttcctgcatcctccccagggggccccatatcagtgttcctgggagaagagcacatgcctgcagctgtggacacagcatctgtcccctgcctacaggtgaacttgtcacccactttctgaccactgacgtggacagcttgtcctacctgaagaaggtctctatggagggccatctgtacaatggcttcaacctcatagcagccgacctgaggtgggtctgccagagggggatggcggctctgcccagcactgcctcgggggcaggcctcaggctcatcaggaagtggggttccactgggggctgtggcagcctctccagggacgttgctcctcgtgacttggcaaacattctgaggactgagcctgtcacagatgtaccaactcgggtatttgggggtgaagcccaaggcttcctgtgatggcatgagggctgccggatccctggagaaagctgaggctgtgaagaacagtcacatagagtggctctggccgggtgtcctccctcccacgggcaggctgtgcagagcagccctccgcagccctggcttggagtgactgggatgctgtgctcccagggaagctcctgttggagatgaggccgcaggaactgcggaggttttggtgttttgcccttccgtgaagtgagcattcctccctcctgccctcctccccctccaaagccccagaacttggccaatgctgttagtccggggccttctgccaggacaggcaaacgggaagtggtcggcacattgtggcgggccctgaagctgcctccttccacaagggcaggtccatgggcctctctcctggctcccgagctccaggcctgctgttcgttgagcatcccttgtgtgtggcatgcccagccctgccccacatgggtctgcacacttgctatggaggctgggagagttgcagtgtcccctaggtggaaggccgagggctggtgcggggcacttgctgtccggagccgttcttcctgcccatgccttcgtgactccaggtggcagagcccctgtgctctctgcatgcccccatgctcaggaaccacttttcccggtcagtagttccatgtgggtctgattagtctcaggagagttcctctgcggccgtggcaccagcaggacttggcactcagcagctgtgtggaggtggggtgccaagggtgccatgccttgagcagatacacgggctcctgtggttgggggttgggggtttgggctcctcagagcctgtgcaactctcccggctccaaaggctgcagagtgagggtcagcctcctggacctagcctgaggatacaggcagtggccaggagagcataccacaggtcaggcaaaagctggtgccagggccgaggctggagggcgggggcatcggaggtcagtgagcagccctgctggtaggtgcagatgaggaagccaaggcctggaagggagagaggcttgtcatggccacagctatccctgggtgaggcctgccctccgcctggcctgtggtatagtgctggcagcatgggtgtccagttctgtaggtccttacacagaaagcccagaggagatttttgcctgcaaacagtctctgaaattatgaaccaagtatcttaggaaagttgccaaagaccatggtgaggaagaacgggagtggaatgtgaacatagacgggggggcccttgaagcctaccaggggtggggaaggtgggtcccacctgggggcagcacttcggggaggaaggcaccatgcctggctctttctctgcatctgttccatcttgaaggcccagggctccatgcccagcatctggcctgggagggcatctcacaggccacaaagagatcctcttcactttgcaaaaaaggcactccaagttctagaagacttactgtggtattgaggattggaatattttcagctggggagcattttgaactattttctttttaaaaaatgatttatttattttgtagagatggggtcttgctatgttgcccagtctggtttcaaactcctggcctcaagcagtcctccctccttagtctccagattagctgggactataggcatgagtcactatgcccagctctactgtcccttaactattttaaagtgtacacttaacacttgagagtaggaaaatgtggtctttggcgctttctttggaagcctcgatcaccctggggccacactggggccacctgtccagaaaccctcatagatgagctgtggtaaggggcctgatggagaggttggtgatgtggggatggggctcagccctgcagttgtccccatgggcagcctctgtgtgtccatgccatggggcattcggcatggcaggagggcattttagatcctgtgcctcctgggctggtgggccccgaggtgagctgggaacatacccgtgatgctggacaagagctggggcctccatgaccccgcctgccaggcacctgaggggctgggtcctgcaagctcctgacctggccgcagcgggctactgcgcacatcgctagcctccagaaacagggctgtgagatcaccgggcagtgtcggggaggacgccctatggctgtagtctgacattctctccccttggcctgcagcacagcaaagggagacgtcatttgctactatgggaaccgaggggagcctgatcctatcgttttgacgccaggtgagcctgccctggcagcctgatggggtgggggactgtttctatgcagaggtcacccttgtgctttttagagaccaggcacttgtcatattactcttctgagatgactttgtggccatttaagtgccttatggtctgtgggcaccttgccctgcacctggacacttcagagagccctggctccctgctcaccccctccccatgggcttttcctgctgagcaaggtgcgcccctgttctgggcttcccaccgcagccctgcagcccagccggccacccccagcctcacttcctgtgccgtcccagtgtgccctgtgcctgttccttctcagaacctctggagccatcaccacctggggttcttgcctggtctgctccctgacgcacaagtacacaccccactcaagccccacacagatgcacgcctcctgcacccagtccccagtctgatccccggtccccatcctcagggcctcgagcccctctgcgccaggtcacactccacggctgggcccttcctgccctggctctgcaccactgcccaggctgtgcctcctgctacatgcccttcctttccccctcctcgggtgctgcgatttcctggaagcttcctctgccagtgccccaacctggagagaatgtgtcacattgcccccctctgcagccatgttctgggagggaggtctgcatcttgtcccaggtctggtgccaggacaaagcagcactcctgggaaatggcatttcccctgggtgcacaaaactgtagggaccatagcctaggttccggggactgctggctcactcactcccacactcgctgcccacagacactcctcgctggtggcatcgtggaactctgtgccttaaacgcccgctctggtccctctactcaagctgctggctcacacagggtgttccggcgcctggggagtgtgtcagtgcccttagcgccacccacacccctctgtgagggggctccctcacacccctggctcctctgaagctccatgcccacgtcacacagactttcttttgcatttggcacaaatcaccaagtgaggttgcaggtcacaggtgcacaccttcccactgggtgtacacggtggaactgaagccccaggcgtccctggaggggcccgagggagatgataagcagtccccaggacagctgagtggccccatcccacctgcatcttagggggctggtggtgctgacgggctcatcatgagtcctgtggtccttgcctggcccacactggagctggcttccagcttcccacgtctgcccagtgatgtttcatccacagataggcccagcccccatttgctagggtggtgcccagacccgaacccctgggctagttgggatctccagaggaggcatctgcctggagggtggcttccagtgtgtcccacccactgcccccacgcctaccagctggtgccctctcctccacctggggcttatccttccggccaccctctgtgaccctggtcttcccctccctaccttggatacaactgtgggcagcccacctgagctcccaagagctgggcagtggcacagacacagagactaccagcgaggcagggatgtggccccagaaggtcctgagcttgcaaaggattgttctggctgtctcagccagctcttgctgttccacctgccccagaacctccgcatcagttgagggtcgtggggttggaatgtgtggcgaagtaggtctgtggcagtggagttgggccatgctgagcctgtgactgcccaggagagaattggaaactaaaaggtgcaaaagcagtcagagactccctaccaccccctcactgtgaacattggcccagcggcctctggggcagtcgctgtaaccatccacgtggcatcctcggttctcagaggctgagacctccgtggctggagatgcttattttctgctcagttgttgttctgtagaacttatttctgtctacatcctgcctcatccctgagcctgccccacctggtccacattgcctttttttttttgataaagttttattgagatatgactgactagcggcacagttcacccatttaaagtgtatcattcagtaggtttcgtttcattcacagagttgagcaactgtcatcactacctaattccaggacatttcttgatccccaaagaaagccatacctgtcagcagccactccccattccccgtctcttcagcgcctgcaacctttaatctgctttctgtctctggatttgcctattctggacactttgtataaagggaatcctataatatgtagtttaggggactgacttttttcacttagtgttgtcgtctaaaaactcaccagtggcgaggcacggtggctgacgcctgtaatcctagcactttaggaggccaaggcgggcagatcacgaggtcaggagatcgagaccatcctggctaacacggtgagaccccatctctactaaaaatacaaaaaattagccgggcgtgttggcaggtgcctatagtcccagctacttgggaggctgaggcgggagaatggcgtgaacacaggaggcggagcttgcagtgagctgagatcgcgccactgtactccagcctgggcgacagagtgagattgcatctcaaaaaaaaaaaaaacaaagaaaaactcaccagcatggctaaatgatagaaaggagagttttatttgccatatcagtttgcagacccggaagagagagtctctagcatggactgaggtgctctctttgaagaggggaagggcagtttgagttttatgcctcccaaggtccatatcacacaatagagtcatacatattcagcaggtttggggaaaagccatacatatttatgaggggacccgagaacatatgcaatagataaacatacatgtaacatacatcccatgttcactttggggcagggttttagcattaaaatgaggtagaatctggatctttccatcagaaggtgagctctaggacacagttggagtgcagcctctatgaactgctgaaactggcttatggtctgtagttgcttatcagaaaagagtgtttgaaggctggttctctgtccagtcagggttgtggtggtctgggctgtcaagagttaggagggtctgataacgtgtgtgatctctactgttgtgagggagtttatcaagactgtggtttttcttgtagctgtaggaatttagggagttgctgagacagctgccctgaaccctcgagccagttggtactttttgtttcttccctttatccattaatggacacttgagttttttccaccttttggctgttggaaacagtgctgctcacagtgtgacctcacagcatttgtgtggtcatatgtttttatggctctcatgtgaatacgtaggaatggagttgttaagtcgtatggtaaccctgtttaaccttttgaggaacatccaaactgtttgccaaagcagccgcagcattatacattcccaccagcagtgtatgcgggttgcagcttctctgaatcctcaccaaaacttgctatgttctgtgtttttgatgatagccacgatagtgggtgtgaagttgtgtggactcgtggtttggtttgcgtttctctgatggctatgatgttgagcagctattctcatgctcgttggccatttgtatgtcttctttggagaaatggttattcagactgggttgtctttttgagttataggagtgacttatacattcattctagctacaagtctcttatttaaagcacaaagcttaaaatttttaagtcctatgtctctctctttttttttcttttgttgctcatgcttttggtttcttatctaagaaaccattgcctaatctaaggtcatgaagctttccccaatactttcttcttagagttttatagcttttgctctttcacttaggtctttggtttgacttaagttaactatttttttttttttgagacagggtctggctctgtcacccaggctggagtgcagtggtgcagtcatggcccactgcactgtcaacctcctgggcttaagagatcctcccagccgggcgcggtggctcacgcctgtaatcccagcactttgggaggccaaggcgggtggatcacaaggtcaggagatcgagaccatcctggctaaaccggtgaaaccccgtctctactaaaaatacaaaaaattatccaggcgtggtggcgggtgcctgtagtcccagctacgtgggaggctgagacaggagaatggcgtgaacccgggaggtggagcttgcagtgagccgagattgcgccaccgcactccagcctgggcgacagagtaagactccgtctcaaaaaaaaaaaaaaaaaaaagagatcctccctcccaagtagctgggactgcagatgtgtgccaccatgttcagctaacttttatgttttgtagagataaggcctcactattttgctattttgccgaggctggtcttgaactcctgggctccagtgatcctcctgccccagcctcccgatgtgctgggattataggagtgagccacctctcttgacctgagttaacttttgtgtatggtgtcaggtagagtccaactcccttctttgcccatgactatgcagttcaatggtcttccatgttgttcatgatggaaaaagcactgtgacacctggggctggcggcttggctctgggggccccagcagagccaggctgtctccctgggaaatgcctcggccaagatattctcctggaagtctgacagggagagggtggtgtcttggtctccctggtgcatcatttggggtgcttggctcccatcaagcccacccctgctgccctggcctctagagaagagcctctgaggtgaggtgcttctccacctcaagtccctgcccttcactttctgtgacatgagaaacccttttcctgttggccatgccttctgccaacactctgggagcttgttcagagtctgtgcagagccccccggctctcctaacctggggcctggctggtacgcagaggtgggccatgctctgctgaggcccagcctacacctgtgcccactgtgtggcgctgttgggggttccccaaacagggacatgattgtggtgggtgcctcctggcctctggtggctaattctcccactcttgaacttctcaggtggccccccaacctggcgtgaggtgaagaggttccctcttggctgtcccctttgcctgtgagatctcaggttgctcatttcttattcatccatccatcgaggctgctgggcatctgtgccttgtggtctcctgtgggtgcccgcttccgcctactgctgagttctcctctccttgccatgccatcaggtcaggaatgagcatggggaaggagctggagcatggagcggcttggcctcagtctggcctgatttcatggtccccagctgtaccccgtgttaggtgggtggcaggtggcaatttgccctgacatggcacagcagggcctctgcatggcccgctgattgctcctcacaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggtgagccccagtgtcccgccaccagggcagagggaaaggcaggccctgctgccccgggaggcccatggaagtggccaggctgggtccccagctgcagggaagctgatggatatcctgtcctccctgcctgtccccttgagccagctgaggtttccaacaccagggacttttgatgacagaagatgggcccaggcccaggcccaggcccaggggaggctcagtgcacccagaggcttgatgcagccacgtggggcccagagcagatggatgctcccctctgcatgccgagagcttgtgggaagttccagaagattctagacactcagcaaacccaggcggaagagacacatcatggaaatgagtggctagggtcagcacgctcagggttgatgggcttcccgcaagcggtctgtccccagcgaccctgggctgagtgctgggcagggacttgcagttccgggaactgcctgggtgtaggagctcccacccacttccttgcccgtaggcctcaaggcccctcaggggccaggcactggggtcttcgttgccccagccgggggtcctggtgcttgccatgccagcctttctcccactgggcgagatgccccacccatccctcgctccccacccaggtcagaccactgccctgcccaggtgatccagcgtccactcccaccctgtccagcttgcccccttcagagaagcacccatggaccatctcccactcctccccctggggcccctttctgccccctgcctaccctccttctcctctgggcctctgataggcggcctcgtccttcagcctcagcatcgctgcctcactggaagagccccacctgggcatgcccagcagcccctcccagctgtaagtccacacagcccccatcaatgtgccatctggggcaggccgaggaccggccctggctgccctcactgatggctggagccccgatgctagctacaatggctggcttgagtggacttctgtcacagaggcaaatgcccacagggcacctcttggggcaggcagggagcttgtatgtgccatctggggccaaagctccacgattgagtcataagttaagggtagatggagattttccgccttgagcagaaacgtggaggaaacacgcctggtgtgtgactcacgcctgtaatcccagcactttgggaagccgaggtgggcggatcacctgaggtcaggaggtcaaaaccaacttggtcaacatggtgaaactctgtctctactaaaaacacaaaattagatggctgggtggtgcacgcctgtaatcccagctgacggctggagccccgatgctagctacaatggctggcttgagtggacttctgtcaggagaattgcttgaactcgggaggtggaagttgcagtgagccaagatcgtaccattgcgctctagtctgggcgacaagagtgaaactcctcctcaaaaaaagaaaataagagaaaagagaagagaagaggaaaaagaaaagaagaaaagaaacaacccttgcagttccccggccactccccagagccagttaggccaccaggtgggctggggctagacccggctgcgggcgggccacagagggactaatggccaccacttctctccatcctgcaggcagctgccagacccggccatcgaggaccagggtggggagtacgtgcagcccatgctgagcaagtacgcggctgtgtgcgtgcgctgccctggctacggcaccaggtattgcagcaccgtgggtgcgccacctcctatcccatgtcccacctcccacgctagagggccggcaaagaagccaagtgcccatagccagagccaggcttcttcctcgcctgagtggattccagagcttctgccctgtccagacgcagctgcagggtgagcagataccacaggctcccggggccccacaggctgggcttaaggagccagtacacagccacacagggccaggatggcttcagggctgcctgcacattggtggatccctgcgggcaaacgccccggcaccatggcactaggcctgcaggctgtacccttgggtggtggctgctggccagcctttcctgcctggggctggctggcccattggcaggtgcagggtgtcatttccttcagcccctcctctgtcataggctcatcttcctgtgtgtgaggggaaggcaagtgccaactccactccctggcaggccgcatagccgctgggtcccaccccacggggtgcactgcgtatgtgtctgccctgggaaccagcctgtgctggggctgttgggggatccagggccaccctccgtctgcaaagcccacggcagagagggttggaggagaggagagtgtgctgaatgtttgcttcaggtgggctggcatggcctgggcagtggaagagagggcacaggagggaagccttccagacagaggaggcctgggccccaagtggtcaacagcttgacctcttggaagaaccaagcatggctgtgtctgggaacctgggcctccaaaggggaagtgtgtggtcagcccgcaggctgccctatgccttggctcatgctacacggggagagcagggcagggtggggtggttcccagtgaaggtggcaggactcagcaagtgtgggcctgtggagccagccaagagctcacacgccactgatggcccctcatcatccccaagactgaggctgctgctctctgtgacttggcacagcctccaggcatggggttcctaactctacctgcctgcattcttgccctatttgtggctgtgacaggcagggcagggctgagggacaccaggtgaacgagggcccctgctctctttcagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcatttcgaggcctttcccttgtatgcagggtgccagtgggagctgctatgtctcctgtgcagccagacaccctggacgaggcccttcccacctccccctttcctcacggcttcttcagcaccacatgtggatgcctgtgggtcagtccatctgtccatgggcaggggccgctgtgagagaccccatgcgcgtgggatgtggtagatgctgattatggggccagccacccatacaggtctatcaggtcgcaatggaggccccactggagcgggaggcaggctggcctggacttctgttggatgatgggggccaggggatggtaggaggggcaggagagcaggtctgcatctgtctcagccccaggagctcctggtttggggccagctctaaggagcttcatccctgagcctggccgagtataagggggtcccggatatccaatgctgagacctagacttttctaagcctctgcacccaacccctaacttggccttttcagacccatgagagtgcagggtgggtgtggacctgcgccagggcttcccagcctgattgtgacatgatgtgagtccacctagggaggagcaggggcctccccgtctcttccccttcttgcccagaccactttgctgggctcagagccttccatggctcactttgaactcagaagagtttcccagctgcgacccaggctgcacccccaggcctgaggagaaactgaggccccacatcccatacgtgtcctctgagtcaggacaacaggctcccggctgggggcactgcccttgctgccaacacattcacctgccccagtggctaccatgtcctgtgccggtgaccagtgccagtccccaacctggatggtgccctgccctcatgaagagccccccggatgttcacctctgcccagagacccggcctgcccaggaagagcagtctctgctcttgtgtgggtccctctgcccccaccctgcccagggctccccagcagcctgaggcccctaaggaagaacagccctcaatggtgattctattggtgttatgagttgtgtccccaaagagatatatcagtgtcctgacccacagtacctcagaatgtgactgcatttggagatagggttcttccaggggtaaccaaggtagaatgaggtcgttagtgtgggccctaatccaatatgacggctatccttataaaaagaggaacatttaggctggatacagtggctcatgcctataatcccagcaccttgggaggctgaggcaggaggactgcttgagctcaggagttcaagaccagcctggggcaacatgtcgaaacgctgtgtctaccaaaaaaaaaaaaaaaaaatacaaaaattagctggccattgtgactcacacctgtagtgcgaggctgaggtgggagaatcgcttgaacccaggaggcagaggttgcagtgagccaagattgcactactgcactctgcctgggcaacagagggagactctgtctcaaaaaaacaaaaaaggaagatttgggctgggcgcagcggctcacattgtaatcccagccctttgggaggccaaagctggaggactgcttgagcccagattagcctgggcaacatagcaagaccccatctctaaagaaaaatgaaaattaaaaaattagcagggcatggtggtacacacctgtagtcccagctacttgggaggctgaggtaggaggatcacttgagctcaggaggtggaggctgcagtgagccgtgattgcaccactgcacttcagcctggatgatggagaaaaaccctgtctcttaaaaaaaaaaaaaaaggaaaaagaaagatttggacacggacggatacgcgcacaggaagaacaccgtgtaaagactggaattctgctccacgagccaaggcatcaccagaagctgggagaggggcctgcttcagagcctctcttagagccttcagagggagcagacctgctgtcactctgatcatggacttccagcatccagagctgtgtgacaataaatgtctgttatcttaagtggttcaatttgtgatgcttttttttttttttttttggagacagggtctcactccattgcccagactggagtgcagtggcaagatcacagctcactgcagcctccacctcctgaggtcaggcaatcttcccacctagtcccctgagtagataggactacaggtgcatacgaccacgtccagctaattttttgtattttttgtagagacggggttttaccatgttgcctgaactggtcccaaactcctgggctcacatgatcctcccaccttggcctcccatagtgctgggattacaggtgtgagctactgagcccagactgtggtgctttttttttttttttttttttttgagacggagtctcactctgtcacccaggctggagtatggtggcacagtcttggctcactgcaacctccacctcccgggttcaagcaattctcctgcctcagcctcctgagtagctgggactacaggcacctgccaccacgtccagctaattttttgtatttttagtagagacggggtttcactgtgttagccaggatggtcttgatctcctgaccttgtgatccgcccgcctcggcctcccaaagtgctgggattacaggcgtgagccaccgctcccggccgactgtggtgcttttttaaggcggccctaacagactaacacagtagtgatcttcactttacagatgaaggaactgcggcttggggagataccataacggccccccggttccgagacaggtggagaggcagaaccatgggccaggacagaataggatgagtacaaggtggcatctctgggggtgcctgccccacagatccatggtcttcccatgctggtgtccccacaatgtctggcactgctccccgcttcaccttacttgcccaggcctacccccataccctcagctcacagctacacactctgcacagctcccaccccagggtctttgtgctcacagttcccctgcagatacccaaaccacactcttcccccagttcctgcaggtctttactgaagtctcgggcaggcaactcatttaaagtttcagtttagcccagcacggtggcacacacctgtaatcccagctacttaggaggctgaggtgtgagcgtcgcttgagcccaggagtttgaggctgtagtaagccatgattgcacgactgcactccagcgtgtgcgacacagcgagcccccatcttgaaagaaagaaaaaagaaattaaaaaggaggctgggcactttggctcacacctgtaatcccagcactttgagaggccaaggtgggcagatcacttgagttcgagaccagcctgaccagcatggtgaaaccccatctctactaaatatacaaaaattagctggacatggtggcggatgcctgtaatcccagctattcgggaggctaaggcaggagaattgcttgaacctgggatgcggaggttgcagtgagctgagatcgtaccactgcaccccagcctgggtaacagagctagattgtatctcaaaaaaaaaaaaaaaaaaaaaaaaaggaaggaaggaggaaggaaagaaggagggaggaagaaggaaggaaggaactctctttttctctatggcaatgagcacgtaccatctggcatgctgtgtgctaggattggttcttgcctgtctccatcagaatgggagcttcaggaaggcagggaccttccttctcttgcccactactgtactctgatgcccaggccaggcaggcatttgagccaagaatgacagtgctggtgcttcccaagcccccatctatttgggccaaccccttgatgcaaggcccttgtgctaatagagggtataggggtccaaagccagtgccttctagaagagctttggacgtgacaccaggaatggctgggcctggacaatggccttcctggcactgcccagccagtcctctgtgcttgttgccagatgcacctgatccctgagtccccagcatgggtctctttctcccaggcagatggggaactcaccttcttctcagatgccccttcccaacataagctgcttctgccctctggccccgagatggccaaggtgagctgtgtagacatagagtctggaggcatggggctggctaacgtggaggcaattctatgaacagacatggccaggccaggaatgcggcatggcctcaggtctcatccttgaaggcctgggctcctggtctgcctgcagacttcctgagaccacgtcttgttctcatctgccagcagatgcctggctcatgggtgagccgggcttaggtggaaacacaggagcccagaggggaaaggatcctcccccagcttgggctggagtcccaacttccaatcatcaatctttgcaaccctggggctggacctggctagttccatggtaaggatccttctccgtcacccagtcagtcccaggctgtgtgggaaactggctgtggtgggcaggtctgaggtctcaagtctgacaggggccactggagcctccaactcaccaatcaaccaagtgtgagaggttgctttggttgaatggccatgtgctggggtctgactggcccagccacagggaggctggcatcccctagctgagtcctggacccagaccctccagggcatggagcccattgtgaggtgtctggtgctgaagtggtgggggaggcccgtgcaggcctacagctttgtcatctgcaacattcctctccccactttctttaaactttttcatttagaaatgatttcaatggccaggcgtggtggctcatgcctgtaatcccagcactttgggaggctgaggcgggtggataacctgaggtcaggagttcgcgaccagcctgaccaaaatggagaaaccttgtctctacgaaaaatacaaaattagctgggcatggtggcacatgcatgtaatcccagcactttgggaggctgaggcaggtagataacctgaggtcaggagttcgcgaccagcctgaccaaaatggagaaaccttgtctctacaaaaaatacaaaattagctgagcatggtggcacctgcctgtaatcccagcgacttgggaggccgaggcaggagaatcacttgaacccgggaggcagaggttgcagtgagccgagatcatgccattgtcctccagcctgggtgacgagagtgagactccgtctcaaaaaaaaaaaaaaaaaaatgaaacctcgtctctacaaaatatacaaaaattagctgggcatggtggcaggtgcctgtaatcccagctacttgggaggctaaggcaggagactcgcttgaacccaggaggcagaggttgcggtgagccaagatggcaccactgcactctagcctggtgacacggcaagactccatctcaaaaaaaaaaatttttttttcaatttactaaaggatttaaaaagtagaacaaaaaattctagtgtctttcacccagttaccccaaatgtgaatgccgcacccaatcacagaaaaatgattacaaccaggaaattaacactgataatgttaaagaaagaattactgaatgacatttgctaaagcactgtagggaagactttattcaggaccgtcttgctaggtctagggaccacaggaatgagattctgcagtgggggagagagattaagctcaagtccgaatgggcaagtgggaactgatgatagctgaggagcagggcggtgggagctgggtcagcacatggaaaatgactaagaagaaacaccccgggtgagggagattctggctacaccaattaacaggatttttgctgaagacaggccacagtgaccggacatcttcacctgggggacagtgtaggaacggattagataaggagggtgatcagatgtcgagggtcaggggatgcttcttgctaaagtgactttgcagggttcttgctctaagtgaaatttacaaggaagtgcacagatgggcctagaagaaggttcagaagcctggtttggccaagcaaagaatctttgtcggtccctcctcttgttcaaggaaagaagaggttatctttccttgaatagtacgagtccatttccttgctgggctgccttttgttcattaaaggccagctgaatcatctgctgggaccggcagtagaggagatatcctccatggtgtgagccatcaggcgttgcatgttgaagataaaagaaaaagatattagttggaaccaactataaactcagtttctgagttcagagggcagctactcaagatttccaggtgctgtgcttgaagcatcttcagatggagtaggggctaacagactatcatggacggcagtttgcgtgtcatgaagtctgcccacaaattatctgttgtggtgccatcttaaagtttctttctttttttttttagacagagtcttgctgttgttgcccaggctggagtgcagtggcgcaatctcagctcactgcaacctctgcctcccaggttcaagcgattctcttgcctcagcctccagagtagctgggactacaggcacacaccaccatgcccagctaatttttgtaatttttgtagagacggagtttcaccatgttggccaggatgatctcaatctcttgacctcgtgacctgcccacgttggcctcccaaagtgttgggattacaggcgtgagccaccgtgcctggcctaaagtttctatcaagttgtccgggttcagcttaaagggcttcaggaaatgggaagttttaatttttagcggttccaggccagaagggtgggaaaaaaactggaaacatcagtttagagaaaatcaaatattggaggaaactagaagaattcaggatccaatccagtttgtaggtaaatatcaaaacctcaaaaacaatgaacagggctagaatctgataatgggtgcactatagttttcttctgaaactaatttttctctatatagtcaccccacttctatcaaagatgttgaagtaagactaatttgtttgtagctaagtttaggttgattaaacttggcctaattacttacataagtgccgcaacaatagtgattgaacacataggctttctttaagtttcctttgctaggacttttttttttttttttttttttttgtcacggagtctcgctctgtcgcccaggctggagtgcagtggcgtgatctccgctcactgcaagctccgcctcccaggttcactccattcccctgcctcagcctcccaagtagctgggactacaggcacccgtcactatgcccggctaatttttttttgtattttttttaatagagatggggtttcaccgtgttagccaggatggtcttgatctcctgacttcgtgatccgcccgcctcggcctcccaaagtgctggcattacaggcgtgagccaccgtgcccagcctgctaggacttttaataaggcatctcagattgggcttttaaaagccttgccaggctaggaagccaagccgaagcttcaccatcatacttcatttgcaatcattataggtttgggtgaattcctctctttttgaggtcccccaaaatatcctgacatccttgggcctgtcaggaagtgactttccttactcacctacaaggcaaccacatgacccatgtattcaaggtttaaaacccatttttccccaagggctttattggttccataaagtcatcttagttacttaaagttgtctggccatagctaaaaatatggcattctagtcaaagctttggtaatataaacagcatttccaattgtgtcctgttacaaagagaacaggttcttactgaacttatgtaaataaccatattgccattaaaataaaaatactcatgaatagtttccgaattatggaaggataaggtacagagaaaaagtaattgtttcacttttgtttacaaaggcatactttaccaaactgctgtaagctatggataacttaaaagagaaaaaaaagtttccttaaatctggaaaacaaaacattaaagaaccagcaatgtttcaaacaaaacataaaaaaattatcctggctgggtacagtggctcacacctgtaatgcttagggaggctgagatgggaggatcatttgaggccaagagtttgaaaccagcctggtcaacatagtgagaccctatctctacaataaaattaaataaataaataattgtaattggtttattcattgccatgtaatttattcttgttctgtttgatcttgatcagcagtttcacgaacccctcagtgtcttcattcaagttctggaaattctggccaggtgtggtggctcacgcctgtaatcccagcactttgggaggccaaggcaggcagatcagttgaggccaggaatttgagaccagcctggccaatatggtgaaaccctgtctctactaaaaatataaaaattaacagggcgtggtggtgggcgcctgtaatcccagttacttgggtggctgaggcaggagaatcgctggaacccggcaggcagaggttgcagggagccaagattgcaccactgcatgctggcctgggtgacagagtaagactatgtctcaaaaaaaaaaaaaaaaaaagagttctggaaattttttttttttttttttgagacggagtgtcagtcacccaggctggagtgcaatggcacgatcttggcttactgcaagcttcgcctcctgagttcaagtaattctcctgtctcagcctccagagtagctgggactaaaggcacacaccaccacacccagctaatttttgtgtttttagtagagatggggtttcaccatattggccaggatggtctcaatctcttgacctcgtgatccgcccgcctcggcctcccaaagtgctgggattataggtgtgagccactgcgcctggccccagccacatttcttaagtaatcaaaaacctaataaaagacaatatgaagaacaaggaactatcttgatataacacaaaaatctttgtttccaaggtcaattatttaaaaggtaaacagaggccaggcgaggtggctcacgcctgtaatgccagcactttgggaggccgaggcgggcggattacgaggtcaggagatcgagaccatcctggctaacacagtgaaatcccgtctctactaaaaaaatacaaaaaattagccgggcatggtggtgggcgcctgtagtcccagctactcgggaggctgaggcaggagaatggcgtgaacccaggaggcggagcttgcagtgagccgagatcgtgccattgcactccatcctgggcgacagagtgagactccgtctcaaaaataaaaagtaaaataataataataataataaaaggtaaacagaaatcttcataatctcaaatactgtaagaaaactttgtcatttcaacagagaagatcaagttaaagttctgcatcatagcactactaataaagctaattttaacaaaaccttataaatgaatccatccaatctcatgcaagataatatttcttttccaagatttcttttctatagatcttttacaacttaaaaaaaatatctggccgggcacggtggctcatgcctgtaatcccagcactttgggaggccgaggcgggtggatcatgaggtgaggagatcgagaccagcctggctaacacggtgaaaccctgtctctactaaaaatataaaaaattagccaggtatggtggcgggcagctgtagttccagctactcgggaggctgaggcaggagcatggcgtgaacccgggaggcagaggtttcagtgagtcgagatcttgccactgcactccagcctgggtgacacagagagatgccatctcaaaaaaaaaaaatctatcagtactttttttcccctacattttttttctttctcattctggaacaaccagttgctatatatattagcacagagtcagttattcctttaagggattttataaattaatttggtgctactatctggaggtagaaaaatatcatgtatatataacatacaaacatacatatgtagttgctctgcaactgaagttggcagaggccagacccagtggctcacgcctgtaatcccagcactttgggaggccaaggcaggcagatcacttaaggccaggagtttgagaccagtcttgccaacatggtgaaacctggtctctacaaaaatacaaaaaaatcagctgggcgtagtggcgtgcgcttatagtcccagctaccttggagactgaggcaggagaatagcttgaacccaggaggtggaggctgcagtgagccgagactgcgccactgcactccagcctgggtgacccagtgagtctctgtcttaaataaatacataaataaataaacaaacaaataaataaagttggcagagtatatagtctgaaggggtttgaggaaaggggattcaggtgactgagaagttccgatgggagaagtaggatccaatagagagaacagagaggcctcacagtgggaagaaaagactgccagcccaggagtcagggagtgaatccccattcagaatgaagagccacaaggaagaccttccaacccaggaagtattatacctttcaaaagaaggctgggaccttaaaaatcaaaatctgtccttaccagctaaaataaaagtttttctacagtcatggctcaggagtttgactcaccagtagatccccaatcagccagtcagaagacaaaggctgcaaagttgcacattgagagtcctgggtcagaggcctgtggcaccacaaccattaaagaaaaaaattattcagcccttgtcaaagcacggtcgggaaggccttattcaggagcattgccactggcatatggaccacaggcaatggggttttgctgcaggggagagattgggctgaactctgaatacagcatggacaagtgtgaactgatagccaaggagcagggcgggggtcagtggatgaaaaattactaagaagaaacataagtgataagggggatactggctaagctgacctaagaggattcttgctgaagacaggctggggtgatcagacatcacctagaggatggtggagggatgaggaatttcatcagtattgagggcgatcagatatcaaaagcagggtggttcttgctaaactggaattctcagacgggcctagaagatttaggagcctgactaaagtttggccaagcaaataatcttttgtcaatacaacaacacgatactttttactgtttgttttttttttttttttttttttttttttttttgagacagagtctcctgctgtctcccaggctggagtgcagtggcgcgatctcagctcactgcaacctttgcatcccgggttcaagcaattctcctgcctcagcctcccaagtagctgcaactacaggtgcgtgccaccatgcccggctaatgtttttgtatttttagtagagacggggtttcaccctgttagccaggatggtctcgatctcctgacctcgtgatctgcctgcctcagcctcccaaagtgctgggattacaggcgtgagccaccgcgccaggccaatacaatagtattaactaatctacagaccttgtttgaattatatcaattgtcccattaatgtcccttttctgagccaggatcccatctatcgtctggattccacactgcattttgttatctcttttaattgaagatggctcctcagtccatctttgacttgaatgatctcgatacttgaaaagcactggctggtaattttgcagaatgcccctaatttggggtttgtctgctcttcattcagattctgccttttgggcaaaaatacccacaagtgaacttgtgttcttctcaggaggtccacagtatgtcctcttactggaactaacttttttcatttctattgaggcagaatttatatacaatgcaatacacatgtttaaatggtacaatttgctaagtttgctggtgaccttgatggcttggttaaaggtggtgtcgcccaagttttcttccactctaaaactactattttccctaggcaattagtatcctgggggagaaactttgcaacactgaaaacaaaacaaaacctgtttgtcatgtttttgcccactatttttttttttttttgagatggagtctcactctgtcacccaggctggagtgcagtggcgtgatcccggctcaccacaacctctgcctcccaggttcaagtgattctcctgccttggcctcccgagtagctgggactacaggcacgtgccaccatgcccagctaattttttttgtagttttagtagagacgaggtttcaccatcttggccaggatggtcttgatctcttgacctcgtgacccacccgcctcggcctcccaaagtgctgggattacaggcgtaagccactgtgcctggcctaatttttttgtagggggttgggggccggggaccgagtctcgttctgttgcccatgctggagtgcagtggctggatcttggctcactgcaactcctgcctcccaggttcaagcaattctccagcttcagcctccgtagctgggacaacaggcacctgccaccaagccctgctatttttttttgtatttatagtagagacagggtttcaccatgttggtcaggctggtctcgaactcctaacctcaagtgatccgcccgcctcggcctcccaaagtgctgggattacacgcatgagccactgtgcctggccttgctcactattttttctggagacggtctcgttctgtcacccaggttggagtgcagtggcccgatctcagatcattgcaacctccacctcccgggttcaagcgattctcctgcctcagcctcccgagtagctgggattacaggtgcctgctaccacgcctggctactttttgtattttcagtagagataaggtttcgccacgttgcccaagctggtgtggaactcttgagctcaggtgatccgcctgcttcggcctcccaaagtactggggttacaggcgtgagccacagggcccggcccactatttttatcactcaagattttcgtctacagcagctattattggggtggctacccagtggaaaatttttctatttccactattccttccacatttattgacaggaaagctagtctaaggaagagctgtaccctcacttactcagaccctcgttttccttttttttttttttttttttgagacggagtctcactctgccgcccaggctagagtgaaagtggtgctatctcggatcactgcagcctggaactcctggactcaggtgatccttccacctcagcctcccgagtagctcggaccacaggcgcccgccaccacgcggctaattaaaaataattttgggcccggcgcggtggctcatgcctgtaatcccagcactttgggaggccgaggcgggcagatcaattgaggccaggagtttgataccagcctggccaacatggtgaaaccccgtctctaccaaaaatataaaaattagccgggcgtggtggtgggcgcctgtaatcccagttactcgggtgggtgagccaggagaatcgcttgaatccgggaggcaaaggttgcagtgagctgagatcgcgccactgcaccccagcctgggagacaaagcgagacaccgcctcaaaaaaaaaaaaaaaaagaaagaaaatttgtagatactgggctctcactatgttagccaggctggtctcgaactcctgggctcaagtaatcctcctgactcgacctcccaaaactctgggattacaggcgcaagccaccgtgcccggccgaaccaccgtgcccggccgaaccctccctgttttggaaatcctgtattagcaaaggggacagcgccagacagttgagcacacgcgttctttataaatgatgatgtctgatacagtgatgcttttaacagggttgtgtaacgcctgtgtgtgcacggtctcttctgcagtgtccaccgaaggtggcccgtctgcgtgtccgctcccggcgtactccgcgctccctgttcccggcattccccgcgctccccgagcttcccgcgctcccctgctcccggcattcccggtgcttcccgttcccggcgctcctcgcggccgccgccctcagtccagcgagccccgcctgggcagcgactgttagcgcgaccgcggcctgggcgcctggtccctcccgcgcggccgcgctattgggccgcgcgcggcggacacacgcgctacgcgccgccgattggcggcctccgcagcgcgctctgcggctcccccaatgcggggcggccgcgcgcggggattggccgcacgccgcgaaggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtaggtgcggggcgcgaggggcgcccgcgggcggttgggcgggcgccgcggcctgcgcgagggcgcgcccttccctcccgcctccctccgggaccgaggccgcgggcggggcgggggcgcggagcccggcctttgtgaggcaacatggccgcgggcggtggagagcgcggggtggggacgcctccggggctggggggcgggccccgggcccaggcgttgccgactctcgtcgctgtccgcccgggtaaagaggctcctctcccggagggcccgaagcctagcatcgccttcaggcgggaaaggtgtggacagggccagtgctcgcctgggaccctgccggctttaacacagtttgggaaatccaagaagtcgcctaagtctttttgtccacagaatgctcacgggttgagtgtcacgtagataattgggatacggttttattgtaacaatgagcatggcggaaataaatggaaggtggcaacctgttgacagtgatgcctgtctggtgtcaaccgatggacttgggtttcttgtggcaggagtctgatttgcctttttgcatgcttgcatgtaccttgttcctgcacggcagtcctgtctttggctgtcgactgttcgaggccaaccaccaggcgaggatccactgtttcctggccagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggaggccccgtcagctcacctatttctaagcacagaccatttctcaccaccttcaagttaacatcctggcccagcctacctggtgagcctctaattctctttactgtcaccttaggtcctcactccccatccaccatctatagtttttctggacacagagtgattcttctttctttctttttttttttttttgtttttttgagacagaatctcgctctgtcgcccagactggagtgcagtggcgtgatctcagctcactgcaacttctgcctcccgggttcaagcgattctcctgcctcagcctcccaagtagctgggactgcaggcgtccaccaccaccacgcccggctgatttttgtatttttagtagagacggggtttcaccatgttggccaggctggtctcgaactcctggcctcaaatgatctgcctgcctcagccttccagagcgctgggattacaggcgtgagccactgtgcctggccacagagtgattctttttatttttttgagacagagtctcgctttgttgctcaggctggagtgcagtggtgcgatctcccgctcactgtaagcttcgcctcctgggttcaagccattctcctgcctcagcctcccgagtagctgggactataggcgcccaccaccacactcggctaattttttgtatttttaatagagacggggtttcaatgtgttagccagggtggtgtcgatctcctgaccttgtggtccgcctgcctcagcctcccaaagtgctgggattacagtcgtgcaccaccgcgcccggcccagagtggttcttttaaaccataagatggtataaaacagaggcggtgtagatgcaagccagcttgcctgcttgtaaagcagctccatcacttcctggctgtatgaccttgagcatgtgggtgaacctttcttccataatgctatgtgagacctgggtgagttaaaatgcttaaagtgcttagaacagggcctggctgaggtttggttgccactgctatcctggaatcagctgatgccactgtgtgggccttcctatccggtggcccatctctctcactaagagccaaagtcctggcagcagcctgggaggaccagccctgatccatctgccctcatggacttggcccactgtcacgtcccctcagcacactgccccagctggccacaccacattcctgaccccagccctctgcttttcctctcagtgtcacctggaacatcccctcctcccagccctgtaacccacctggctcactcctgccttcacgtggatgcaggccatgaggccttcttggatcccccttcctaaaactgcctccccttcttcaggcgctttccttgttttgtttttgcttgaatacttcttggcatgtgacagggtgcatgcttttcttagttgttagcggtccatctcccccactaaaatgtgagctctgtagggcagggttttgtccaccttgtgtctgtagcatctaggatggtgtgtgtgtgtgtgatgaatggagaaagcttatagaggggaggaaggaacttgcccaggactgcccaccactgaggtctggggctgggcaggtttcctgctttcctaaggagctcactcacttgtaaggcaccaggctttcctgctgtgcatttcttcagtgccgccgcttggccccattagcacctttgcttggaacgtctactctagctgcttcttcgccttctgtggtagcaggcttccccattccgtcccactgttggtctctaatcccctgctccttgtggcttcttcatgtagctttttgtgtcccagaatcatggattgactcaccagggtctctatgggactgccaggttctgaggtgtgtggccctggtcttccttgtaatctgtggcactgggcgcattgacccctcggtctgttttctctaatggtctttcttggttgccaggagactgacctcaccccgcttagtgttcctcatgcctgcctggttgctgcccacagcctcttgagcgtcttcagcactttatagtcagttgttagctctgtgctgtgtttcctggatcctcagcacctttgatggacacatctttgggaacatacggtgtgaaattcccattagattcagaaatgttaggacatcttagaatccaggaaatggggtgacagtgcagtggtcattgacctgccagtgtgtccaggccctgtgaccttgtctcttgtccatatagtgcgttcctcggagtagatggccagtggatagttgttaaatgtattgattaaacctaaactagtctctggttttcatgttgtgtccccttcgaagtacatccaccatgccttgtcccttgttaaatgtgtgatgtctgcatctcctgttctttccgggaatcttgggaggatgttaggtcatgcagtgcggtttgcatgtgtgcatctttactggtatgcacgcatgtgcatgcatgcgtgttcctgtgcacgttgtgggagtgtgcatgtgcgtgtgtctgcatgtgttccttctgctctgatgcagggttttctggctgccccctcagacccatcttccctgcttcatgttgtccctttcttcatgcttcctctgtagtaaggcttcctagagttgcatccttaaccctcatctctgggtggccttcctcctgtgggtttggcgactacctcctcagtgcgtcctggccttccgtatctggaccagtcatggctccagagttgtggcctcggcaccttcagagcctgcctggaggtcccctctgttctcctcgccaggctcctgcctgcatgctggaatttgggtgtccttccttgtctttagttccctcttttctctgctatccacctccgttgggtcaacaagtgcggtcagttctgtgacactgttcttggcccattgccagggcctctttcacacctttgtcctctggcctggaggactgtccccgtgccttggatgcagttgcttctgcctggcacagctgtgggtctcccctctcaagtaggaacctacttgtggcatgagagtcgcttcaccttcagtggctccttattgtccccagggcggaacgggctgcaggtggcacccaggcctctctgtgcctcggctccagctgtctcttgtggctccccaccccaaatcctggcaggtcccttccccacagccacccacccctctcctccatcgggaacagaactatgctgccacctctggtgacctcagcacgctgcatcactgtccccgtccacgtgctaccctgtgggcccaggagagccctggggtccctgggtagcagagcgcctggccatgcctctgaggcccctagtgccgcagagttgagctgagggtctcgcgctcgccctctgactgacccagcccttgcaggtgagtggattgctgtgctctggtggcctgagggaggccacgcgccttctgtgtgttccagaaagggtgcctcccactgcatgcttgcttatctgagttagaagaatgctgtggtggagtttagtgtaaatttttaaaatattttttgagccttatgattatatagtttttgtgtttctgaagtaggaattaaagtgggcattaacaaaatatttaactttggacttaagttataattcaggttctgaagaataaaagtaaggttagtttgttttgatgcctaaaaagtcctcttagggaatattattttgaagccctttactatgctgttaatagtgcttggcttttaacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaacaaaaaccaaaatcccctctgaggtggaataatgttaatgtggagaagagaaagatgtaaggagtccagatttttaaagtttcctaatgaaaagtttggcccatgggtaggccctgcatccctgatctagcgcgtggggcagcaggtgctgctgagttacgctccttggcagtgtgtgcccctggaccaggtgtgttggtgtcagctggtagcttcatcctgtttgtttttcagatgatcatgcaccctaagggcacatctaggccccctgagagcacctcctttctgtgtctgttctcaggaatgctgttgagctctcctgttgcaggagcatgagcgccaggggctctggtgtctgaacagcgtgttttgcaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtacgtgtgtgggtcagaagcagtgggtgttccagggcagtggaggggtggttgcttccttagcagaaatgctttgagagagctctggtgccaggtagtgggctgggtggaggcatgtttgaggacaggacagaaatatctgaggagggaaacacaggatgggaggacgtcctgatgcatgacccagatgcggatcctggtgtgtgctatggaaaccacagagcagcaggcactgtgcagaggaatgggaggggacttctgagggggtcaggaggggatgttggtatatgccaggagccagcatgaccatcagctggagggtgtggagaccaagggcaaggtgggtacacagtgagatggcaggtgatagttgtgatccaggttctagtcctggaccaagtgtcacaggaagccaccagaagcaagtggtgttacctgatttttgtttaacaacatggcttctgggccacagcatggtgtgtgcacttcagctgggcagggtggaagtgccctggtcgacgtggcacttcctcaactttgagttgagggtagtggggagagcacttgagaggcgcccagagttgcactgtgaggctctgtcatcgatgtggtgcaggtgttgggggagtcggagttggtggcttggaggcacctatgagggtcctggtggagatgtggggctcggtagagggactgaagagatgcacggggactcaggctcacaggtgagaccccaggctgagggctggggtgcacaaggtggcagggtgcgactgggagcaaagcaaggggcgggtggcacatggccatcctccttgggccattgaggggacaagttagctatgccaggtgccacatgttgctgcctatgtcgtgttggtagcagttaagcaggagggcttttggtctagacggttgcaggcagggtaaacctggggcttcagcttctggggctgggggcaggagtcttgacctcggggcctctaggaggctggtttggtgctgcattttcaacaggctcattcagaaggtaaacccacattcgtcctgcacagctcactggtcagcagccattctggcctggatgcctggatgttcacagacggacagctgcatgtgacccccacctcaggtggctgggccaactttgtgaccactcactgtcacagaggagcagccccagcggacccgtggcccgtctcttgcttggctccgtattccctttgcttcttttcctgacttaacctaaagctggcaggaggcagctccatcttggcctgactctgtggggagagagcccacgcagtgtgcatgcacccctgacctttaacactccctccctgaatcatcacctgatggtggcctgggtacaggtgtcaggtccagggtcagggccacttggtgggtacctagccctgagagtcactggccctttttccccttatgtatattttttaaggtttcatttgctttcttctgttttttaattttttttttgaggcggggtcttgctgttacccaggttggagtagctcactacagcctcagcctcccaggctcaagtgatcctcccacctcagcttcccaagtagccaggactataggtgtatgccaccatgcctggataattttaaaaagttttttgtagagtcagggtcttgctgtgttgcctaggctggtctttctaagtttttaacttgttcccaatacctgtgagaaaattaagttttagttacatctttgccttacgctcttcccagcagtcaggcctggtggcaggtgtcaagttgataagtcgtaaacctcttcctcacaactgcctataaagcaaagaaggggttgggagtagtgtattaaaccaacttagaaacggaatcatttgaagcagtgttttgtatgctgctgagagtgcagctcagttacaataaagacttgtcacctggtcactgggagcagtggctgacagccatgcagtttattagcaaagctcatccagccccaaggcgcctctggccacaaccagacaggcagcaaaggagtccagtgtccacagtgcttaccagatgtggaggcaggagctgaggctgggacttatatcttgcacagacctgttctgtgctccttcatgtgctggtttgacacgtgtaaattcccacctcaggccacatgctatctgtcctaggcctggaggcatagcagtgagcaaggcagagaggaatttcgattatctgtgaagacccagttaaacacatgctagtacccaacaatttcttgtgcaggaggtgctgtggcaacaattccaagtgtttttacagtgattataggatgttcttgtcttcctgtgcaggtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgcagccaagcagaggccggtgaaaggcatcagagtttcagactctcgggttgtccttgtaatccatattgcaatttcactatccacagaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttggtgagtttttgaaggactcttcccttcttgcctcctgggacccatgagctttgtttttctaatgaaggccataattgttcatagttcctagttgtacttgtgagcaaggggctgtgcacctccactgttggtgtggctgaaaggcttgtcttcctgtccttgcaagaacctgcctgggtgcagcaccctaggctcctgtctgtgggctctgtggtgtctgcatggctgaggctgctggggagatggctgctggcactggcagtgggccgttttctctctggttgtttgtatgatctttccctaagtcttgctttttcagtaggatgtgctcatgtggcattgttttgatttgtcttgatgagctcagtgagcctctttaatccatgactcagtgttgggaaactgtcaccattctgtggatagttccctcttcaatcctgcaattgcttgctggatgtgtactggtgtttcccattctctcttccatgtcttttagcctagtcccgccatttaagtcttagttctctcttcaggtgtggcaggtctctgtgaacccacctgctggattactttcaaagagcactttccattttctaggtttctatttgtctgtacatcactacccagcctgtctcataactccgtggagtgtggggtgccctagaagagcctgtgatgggggctgttgctgaggatggggaagtggcccgggaggaaatgtgacaaatgcgaggccctgtgcagggagctgcctgggtgtgttgctgactacagaggtggccaggatggccagaaggaaaagagtgaggtggtcagagaggtggcgggcgcatggagcccgggtgctgctggcattcgggcacctgttttgatacagggaggaagtcccgaaggccatctgacttttttaagctgtcttttttccttttcatttttgtattcttcctgccccaaataaagtaaaagaacatctcagaaattcatccagaagggacctgccagaataatctgagctggtgtagggaggccttcattctttgcttccctcccctttgaaagggacggggaaaggaaatagtgtcatgtggcctgggcctgccccatgcactgggctgtgagaacctgactcctatgttggaagttaagtaatttgtttctctggtaaatctgggacagatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaaggtataagcctctgcattttaacatcagcagactggttatgctgttatttctaatgtgatgtgttgagggcatgttttatgagttgcatttcgttcaaagtttatgtttatcccatgaatgcaggggtctgccacattcacggtcgtgagcccctagttactgacatggtaacaggaagctgtgtgctagcttgtggcactgcttcacacttgctgagatggttctttttgtcacagagtttgttattaaccccaacgggaaatccgaggtctgcatcctgcacgagtacatgcagcgtgtcctcaaggtccgccctgtctataatttctttgaatgtggtaagtctaaccttccccatttcagtcctaaagaatcacaaggtgtaactttggtcagggctggggaggcaggcgctgaccgctagccctactctactggaacgggaggaaagggaagggtagagagcagcgtgctgcagatgggtggcttgtttcctggagccgcgccccatctgagtgggtggctctgcttttcccttccagtctgtcccctctccccaccttcctcttgtcctgccccatctgccttgctggtttctgatcctgcgttgtcatggacagccttattgcgagcaaggcctccccactgtgcactgggtcctttccctggtctcctggtgcccctgggtgtctgaagggttcttgggcatgcatttcccaccagctctgtcttccttgggtgccctcatcacacctttgtgaagaccagtctgtcttccccttggaagctggagcctgggggtcactcatcctttgaggtggtgtttctttggcaagccacatcttgtgctttcccattccggcagtcctgtgtccgtctttcgtagaccttggtccctgtcgtaggaggctctgcccccagcctcctgctgcccctctggctcaccatctcccacgtgcctcatttccctccactttcccagctgtgccctttgctgctgcttgtctgctgcccgtctccagtcccagggagccccaggtctctgcagtcaagcacaggcccactctctgcagggacagcccctgactgcgccttgtctgtcggtgtgggcagactgtgcacacgcttttgatgtcttgactcgtatgttttaaaacaagtaattttaattttaagagaacccaagtgagccttttggtgcctcggtgaccattgatggtgtgacttacggatctggaactgcaagcagcaaaaaacttgcgaagaataaagctggtaacgtgcttgcttgggtgtcaaagatacgtgctgcctgctgtgtctgcctcgctgcttggttagggaggggctgagcagtggtgacaagtgggggatgtgggtggggcatgtttattttatttatgtaatcatctactttgatttttaaaattacatgctcattggaaaagactcaaatagagcaaaatgtgagacttaaaagtagaaggcctcggccgggcgtggtgtctcatgcctgtaatcccagcactttgggaggctgaagtgggcagatcacgaggtcaggagatcgagaccatcctggctaacacggtgaaaccctctctctactaaaaatacaaaaaattagccgggtgtggtggcgggcacctgtagtctcagctactcgggaggctgaggcaggagaatggcgtgaacaagcgaggcagagcttgcagtgagctgagatcgtgccactgcactccagcctgggcgacagtgcaagactctgtctaaaaaaaaaaaagtagaaggcctctctactgagtgacagctgggccagtatgtccctccctagtcctggccctgcacatattcaggggtgtgcctagagccaactgggctgtgctgggcacatgctgtagtgcttgtttgtttttaaactgagcagcatgtgggcatgccaggagggaggagaagcgggccagcatgctgttggcatcctcccccagtggtgctggctcttaccggcactatttcctgagtcctcccactccatgtttgggcctagccacacagaacacctggcacagcgcagctctgggaaggctgtgtgtcctggcgaagacccactgcccttttggaccatgcccttgccgtttgcattcatgccctgcattcgtggtagttgacattctttcacaaaaagccatttgcctcagcgtccagggttagttggcttcttgtagggtggtgttgggtgtaccccaggccctcgcacccacaggttgattctcgaggtatctgtcattgccgtgtgttttccagaaggcctgctgcccatcttagattctgcctaagagacttttgcagctcaacaaagggggtgtggtggaggttttgacagataacttgcagtggggccttttgtgggggtggagatgccttgggcgtggctgtgtgctcttccctctgcgggatcacccgctttcctccctatgtgctggaacccacttcccttgcccagactcttggctgccctatagacagcttggctccatgtcttgccagcactgatagctctgtggggtctatggagccatcagcccttggctatggcaactccgaccccagtgggcatatccgtgccctgccctctagcagctccctctagcgtctctcagacctggctgcatctctccacccacgccagccactgctgctgccacctggtctaggtacctgcagtagcctgctctcaggcctccctgcatggtccagggcccgcaaagctgttttctcacgtgccaccgaagtggttccctaacatacagctccgagctcctccctgcctgctcccaggaccccagggtgagagcgcacacacccagtgtggcccgtgaggctttctggtagcctgccacacgtctgggcttttccttctgtcctctcctgaccctgtcactgaagtgctgtctctcctcagggccctcgctcagcctctgagctgtggggatgggaggcagcagtgcacagttcactctgcagggtggtgagaagagggcagtgcccaagcctcaccctcgggctcttttttttcatagcccgagctacactggaaatcctcatccctgactttgttaaacagacctctgaagagaagcccaaagacagtgaagaactcgaggtgagtgttgtggtcctgccctgctgggagctgtgtgtgcagtgcggctaccctgccctgttagtgtgagctgggggtgtccgtgggctgtgctcatgccttccatgccctgtaggttagtctcatccagcctccaggttcttctgtttgtatttcataaagaggaaacttgcctgtctttgtataggcagggaaaaaatgtcctttttgttagagatttttgtcctcttttgcagcattgagtgtgcaccgtaaatgtcgggtacacataggtttgtgatgggaatgaatctttgaggcagtctacaagatttagattgttcttttttttgagacaaagtcttgctctgtcacccaggcagtgacagagtttgatcttgacccactgcaactttcacctcccggattcaagtgattctcccacctcagcttcctgagtagctgggattacaggtgtgtgccaccatttctggctaatttttgtatttttagtagagatggggtttcaccatgttggccaggctggtctcgaactcctgacctcgggtgatccactcgcttccgcctcctaaagtgctgggattacaggcattagccactgcgcccggccctagattgttctttatatacttgacccttgagtaacgtggaagttaggggcaccagcctctcacgtggtcgaaaattcacgcatcactttcagtcctcccaaaccttaactacttactggtaacctactcttgaccagaagccgtaccagtaacaaacaattgattaatacatattttgttatgtacatattactacatctgtccccaacctagttttggcaccagagatcagtttcagggaagacaatttttccacagacggtgttggggggcggggatggtttcaggatgactcaagcacatcacatttattgtgcactttttatttctattatcactacactgtaatatgtaatgtaatcactatacaactcaccataatataaaaccagtgggagccctgagcttgttttcttgcaactagatggttccctctgatgacgatgggagacagtgacagatcatcaggcattagatttgcataaggagtacacaacctagatcccttgaatgcactgttcacaatagggttcacactcctatgagaatctaatgctactgctgatctgacaggagacagagctcaggtgtaaaatgagtgatggggagcagctgtaaatacagattaagcttcacttgctcacttactccccctgcccccaccactcatgtcctgctatgcagcccggttcctaacaggccatggattggtaccagtccatggcctgggggttggggacccctgatatatactgtattcttacattaaagtaagttacaaaaagaatgttattaagaaaatcataaggaagagaaaatttatttactgttcttgaaatggaaacatcatcatgaaggtcttcatcctccacatcttcatgtcgaatagctgaggaggagggggaagaagaagagttggccttggtatctcaggggtggcagaggcagaagaaaatttttgtataagtgggcccatggagttcaaatccatgttgttcaagggtcagccatgtgaagaaccatttaaaactagctgtaaacctttttgggtaaatggttatttgtagcaagggcttgtggaattttgaagggtgcattcttatttatataatagctttattgagatagtttacatactataaatttggccttttaaactatataagtggatttttatatattcagagttgtataaccatcataactacctaattttagagtatctcaacacccccaaaagaaactccatacccattagcattccctcttagttctctccaaccaccaaaagccactaatctgctttctgtctctatatatctgccaactctggacatttcatattagcggaatcatacaatatgtggtcttttgtgactggcttccttcacttagtgtgctatgtcagctgtaggtttttatcagaataaggaaatttccttttgttcctggtttgctgagagtttttgtaggaatgatgttagattttgtcaaatgtttttctgcttctattcagatgatcatgtttttttttgtcttttattttagtaatatagtgtattatattggtttttgaatggtgagccaaccttgcattcctgggatatatcccacttggtcatgacatataatgatttttttaatatgttgctggattcattttgctggtattttgttaaggatttttgcatttgtagttataagcaatattgatctgtagttttcttgtgatatctttgtccagtgtaacagcaggtacaggtatcaggataatactggcctcataaaatggttggaacatgttccattttcttctgttgtgtggaatagtttgtgaaggattggtgttcattttttaaatgttttgtagactgcgttcagtgaaaccttctggtcccaggcttttctttgtccagagctacttaattgctaattcaatcttacatgttataggtctattgagattatctatttcttcttgagccagtgttgatagtttgtgtcttttttggaatttttttcccatttgatgtagattatctaattgattagcatatatttgttcctagtatccccatatgacccttttttatttctatatggttgtgatggtcccttgctgtcattcctgatttcagtaatttgaggctttcttctttttcttgatcagtaaattgttacacttgatgatacatcacaggtctctgaggctctgttgtttcttctctgtacttttttctttctgttcctcagtgtggattatttcaattgccctgtcttcaagtttgctcctttatcttctgttggctcacattctgctggtaaacccctctagtgactgtttcataatttctgtcttttttaaaaaaattctttattgggtaatgcattgtttttatactttaattctttttttttttttttttaattatatatatagggtcaggcatggtggctcacacctgtaatcccagcactttgggaggccaaggcgggcagatcacaaggtcaagagatcgagaccatcctggccaacatggtgaaaccccgtctctactaaaaatacaaaaattagctgggtgtggtggtgggcacctgtaattgcagctacccgggaggctgaggcagaagaaccacttgaacccaggaggtggaggttgcagtgagctgatactgcgccactgtgctccagcctggtgacagagcgagactcctgtctcaaaaaaaaaaaaaggaaaaagaaaaaaaatatatatatatatggggtagagatggggtttcaccatattgctcaggctggtctcgaactcctaggctcaagcaatctgcccacctcagcctcccaaattgttgagatgacagacgtgccactgtgctggcattatacttcagttctttagacatggtttcttagtcctttgagtatgttttctgtaggtgatgtaaaatctgtttctggtaagtccagttctcagagagcgtgtatattaaactgcctttcccttcatgtatgggctgtctctactttcctatttctttgcatatctcagaattttttgttattgtcaagaattggacatttaaaatatatggcaactctggaaatcacattacctcacctcccttaagtttatagtttttgtcatatgtccttgctctctatttgtgactgtatcagtttgctagggatactgtaacaaagtgtcacagactgggaggcttaaatgacagagatgtatagtctcaaagttctggaagccagaagtccaaaatgaaggtgtcagaaggctaagagaaggcctttctccgtgggtggaggatagcgatctccatgtccatgcctttctctctgtgtgcatgctggtctccacattgcccatttgatagagacacctgtctcactggattaggccctaccctaatgacctcattgtaatgtgatgacctctgtaaagaccttgtctccaaatactgttgcattctgagggacttcaacatgtaaatttgggggtgacagtttacctcataatagtgactttcctagattgattctgtgaagtgtgtattctttatgatttgtggccactgaatacacgggccctttagctgagtggtctcctgatgcttggacagggattttcgtaaattccctgagccagtaagtctcccggcctgtgatgagagctgtgggtctgtggggctcacctggtgtgctccggtggctgccaactgtcttagcctttgtgtgccacctgcacagagtctccaggtcagtcagctgggaggttttcctgggcctgtgcgcagtcatctccagacatacgctagagcctttcagagccccatggacatctccagcttttccttcttgggttcttggccagcctcttgtttgcccaactagtgccccagcctctggcagctgcagggtgaaacagttgccactggttccttttgacaaaagccctcaggaactgggctgttttcactgagtgagatcaaataaagacaaatcctgccatgaggcttttccagagggtggccaggtaaacccaacagtgacagttctctgggcctggggccttgaggacccgttctccattgagtggctaccactgagctggggagaagggctgggaatggggcgagttaagatgccagcaactccttgttcttagcaagactcgttgtctttcttgaatcaacactcctcagattgttgaaagcctttctttagtttccagggttctgaaagaattaattctgaccatttttgctagtgttcttgttgctttaatggaggagagcagattttggaggtccttattcggccattccagaactactttaggatgggttttgtaaagttttctcatctttgtggactggtgctgttataaaatatggttaagtgtctatggtagtactaacttgctcttaagtttcttgaactcctggcttcaagcagtcctcctgcctcagcctcccaggatgatgggattacaggcgtgagccaccacacctagtctcttgctctcaagtttctacatgttttctgtgctttatgtaactgcttcatcgtggacaggctacagacagattgcagaccacatgtggatcaagcacagtctccaagtactagctgttccaggaagagtcacatttgtccctttttttttgagatggagtctcgctctgttgccaggctggagtgcagtggttcgatctctgcttactgcaacctccgcctcctgggttcaagcgattcttctgcctcagcctcctgagtagttgggactacaggtgcacgccaccacgcccggctaatttttgtatttttagtagagatggggtttcaccgtgttggccaggatggtctctatctcttgacctcgtgatccgtccgtcttggcctcccaaagtgctgggattataggcgtgagccactgcacctggccacatttgattttatttctgagtgacccaaccgtgggaaatatggctcccagggaggcttccaaggccctctggggaagtgcttgcgtagaccctggcccaccaaaactcttagtatgggttgctgcagacgatggtgcctgagttgtgtaggtctcacgctgccttcctgtctgagtaaaagccctgcctgttctttgctatggggtggtggaaatgtccatgaaccactgtggtttctggtgccaggagagggcccagcggggagtcaggttctcagcctccactctggggttcttctgtgaagtggagaggctttgcagaaaccacattgcaaagtagtctgagaaagaagaggtttccccaggtggagaaggacatgggggtggggcatgtggtggcttccgctgtagactcccctgcctggggctttttccacacccctactccgatcctcccacactgcagcctgtctggagctagcgtcatatctccccaggtaaggagctcagtttcgtgggactgcccccacttcctgtgccagccgcaaatgggggcccctgccacccggcacaggacccctcctcgtgcttggaaatttgctaggactcaggaactcaggaaaaattttacttatgaaacttatttttcatgaagggctgaaagttcctcccctctactgacacatttgatttctccggggagcccaccctggccacctcctcagcataagctctgtggtggggtcgttttgaatcacaaaagacaaacctagcactcaggaaatcctcagggttttaagaactctgttctgggaacctgagagaagaccgtgtgtttttatgatgccatgccttggtttagggtgccttttgtatgtgcccctcctgagaagctctttgaccctcttatttgtatatatgtcatctgtgggctgggcgcggtggctcacgcctgtaatcccagcactttgggaggccgaggcgggcagattacgaggtaaggacatcgagaccatcctggctaacacggtgaaaccccgtctctactaaaaacatacaaaaaattagccgggcatggtggtgggcgcctgcagtcccagctactcgggaggctgaggcaggagaatggcgtgaacccaggaggcggagcttgcagcgagctgagattgcgccactgcactccagcctgggcgacggagcgagaatatgtctcaaaaaaaaaaaaatgtatatatgtcatctgtgatgtccccatttaaaaatctgtcagaggggaaagtagcttttccctccgttgtagggtggtgggggtgtttagacaggggtggccatctcctgttcctgggaagtttctatttgctggtcctccctagcgaggctctcaggttgtgtccccgccccctgctcctcccagctgcctgtgcagaggtgccaacacctgtccttggactgtcccctggacagcctggggcgtggggtagtatcccctccttgtgtggactccggaggtggggttgacatgtcaggaggggcgggttgatgcctgtgaggtgtggtggccacgcgtgtatgctacttgattaaaaagggaaaaaaggaacaactggcatcatttccttttcacaaagcttgtggtgatctcttggtattttgttgctagctgtgggttggtggttcatggctattaaatttaggtattagtgaccaagtgttttcttttttttttttcatcttattttaaaatttacatagagttaaattcactttttggtacagtactgtgagttttgacaaatacacagtcatgtaaccaacactgcaatcaagatgcagaacatttctgtacattccaacattcttctttgttggtcaaactctcccacctgtatcctctggtgggcactgaactgcccctgtagttttgccagatcctgaatgtcctcttagtggagtcacctggtacgtagcctttgaacctggcctctggcttggtgtggtgtgacgcatccgtcgtgtggtcatttgtactcctgagtgctggccaccaggtggctgtgcccctcagtgcgtctctccattcttccttgagggacactgacaggtttctgggttttggtgatgggcagtaaggctgctgtaaggtcgtccaggtctgtgtgtgatgggcggattcgtttccttcaggtaaacccttgggatggggttgctgggctgtgtggcaggtgcacgcttatgttagcattgccctcacacctttctcagtcactaggtgaccgtggaagtgtgtctgttttggggctgtctactgtctttcgagctgtgtgtccttttcctgatgccacactttcctgatgacttgaagtcttgatactgggagtcctccaacttcgttattctttctcaaaaaattgttttggctattctagctcctttgctgttccatgtagactttagaaacaatatgtcagtttctataaaaaattctgggctgggtgcagtggctcacgcctgtaatcccagcactttgggaggccgaggtgggtggattacctgaggttaggagttcgagacctgcctggccaacatggtgaaaccccatctctacttaaatacaaaaattaggtgggcgtggtggcgggcacatgtaatcccagctactcaggaggctgaggcaggagaatcgcttgaacccaggaggcggaaggtgaggtggcagtgagccgagattgtgccattgcactccagcctgggcaacaagagcgaaaccccatcttaaaaaaaaaaaaaaaatctgcctgcattttgattggaattgatcctgtagatcaatctggggagaatggacatcctaacaatattggattttccaaatcataaacatagttcatctgttcatttatttaggtcttctttgatatctttcatgggtggtcggcagttttcatcacacaggccctgtgtatattctactagatttatagttaaatattttatgtatggcactgtgatgaatagtaccttagttccaattgattgtttattgctagcttacagagctagaatttgttttatttgcactgatttattctagtagtttttctgtagattccttatccagttttcttctctaatttgttaatgtagttaattacgttgtttttttaaaaatgtgttcctgggataagtcctacttgggcatggtatatgttccttttcatgtgttaatggctttaatttgctagttccctgctgcatctgtgttcttggtgttaaggtcatggtacgggtagtgtcatcaagcgaagtgggaagtagccctcctcctgagtttttcagaagggcaggacagatataggattggtatcatttcttccttaaaatttgggcctggagttttcctaatgggaaagttttaaactactactgtatgaactactaactataactatgactactctgaactactgttgagtttcttgaacaggtgtagggctgttgaggctactgagatagtttgtgtcttgccaggcattggtccatctcatatagatagtggaatgtagaggtgtcgggcgtctgtggtgctcccacacggtcctttggcatctgccaggcactgattgcttaggtttctcctgtgctgtttgtcagaagcaacagggatttgtctgcaggtcacttctgccatctgtctgctctcatgagctggagcctccacctgtccctggcgggttaaccctcagtagcacatgtggcctcaggcagcttggtgcagggcatcctggtgtcggtcttttttttttttttttttgagacggagtctcgctctgtcgcccaggccggactgcggactgcagtggcgcaatcttggctcactgcaagctctgcttcccgggttcacgccattctcctgcctcagcctcccgagtagctgggactacaggcgcctgccaccgcgcccggctaatttttttttgtatttttagtagagacggggtttcaccttgttagccaggatggtctcgatctcctgacctcgtgatccacccgcctcggcctcccaaagtgctgggattacaggcgtgagccaccgcgcccggctggcgtcggtcttttgccagaaacttctgagcgtgctctctagctgtgtgtgtgtcagccactgcctcagcttctccagggccagtcccgaagccgtggggtatgtgggttcttgtgggccgacagcactggacgttgctaattggttggctggttgacaaacccttgaggttccagggcctgatgtcttggtgagtgaccttccctggaaaaagacccatgttgatttgtgcacttgagaggagcagtgtcttctggggacctatttgaagacagtagccaagccatacctcgaggatttttcgcttgccaacctcagggctagtgccttcctcttctatgcagttgcagcgagttggccttgctgcttgctggagcggcgagggcagaggagctgcccactgccctgtctgtagggccagtgtccctgtggagcgggcttggcacactgtggagcctgcacagcgaggcgtgtgaatcatttgattctaggtttcctcgctgcccatgggccaggcaggctccaggtccctgcagacccctccagaacagggccagtgggggaagcactgtgagggtgtggctgatgggtaatctccagtgcttcaaagtgtggtcttttttggaaagaggatgattgcagatagaattaggttaacatgagatcacactgaagcagagcagtggtgtgatccagtgtgtctggtgtttctctaagaagagggaggaggggcagggctagtagtccatatgaaaatcggagcaatgctgccatagccaagggatgccggggccaccaggagctggcagaggctccctagaggcttctgaaagaggatggccctgctgaggccttgatttcagacttcagaatggtgagagaataaacctcttgttctaagccactgactttgtggtatgttgtcacaggagctccaccagggaggttgtccatgctccagagtgggctggatagcatcttcctttcacccaggaggcactctcagcttcagccaaagtcctagtctgggaaggcacagtgggcaatgtctctgcacctcagcctgctgcagcttccctatgcctcactgtgtggaatctccccatcacctcttgtttccctgtctgcctctcttgtccttcctgtgtgttcttgggttggctgcagagccagggtgatgacactgttggaagccttgctgggctgggcctctgctggccacctggggctgggctctgtgtagctgtgtggggctttggcctttggggagctgggccttttaaggccagcttttgggtctggctgactttccctctcctgtagtctcagttgtggcaatagtaaagcctctctgcaaaggtgctttatctttatagagttctgagaagggtgccttatggatcagaatcagatccaaataaggtgggcctggccagccagccatgtacctggggccctcttaggataccagactccatcccacagtgctcagggtggaagggtgctgtgggctctggagatgggcaactggacggtgaggtacggagcatgtcttgtacccggtgggttccttgcagagttgaggtatgaagtgctaggcgagctcacaagaacagacattaagcatctggggaaagccaaccgcaggcccagccatgaagaggccggtgggcctggtggggactcacaagcctctgctttgtgttgtagtattttaaccacatcagcatcgaggactcgcgggtctacgagctgaccagcaaggctgggctgttgtctccatatcagatcctccacgagtgccttaaaaggtagggtaggggggtgcctccccccatgagtcaggtcgggggagctcctctctggcgtctcatattcttgtggctgtttgtcccaaggcagaggcatggccaggtttccctgggtacacagcagccccttggccctggccaccagtcagtcccacaggcctgaatcgggcgtgtggagaattccctcctctggctgagatgcagtctggggagaggcttggtcatttcctaagggcttcccagagcaggcctcctcagaggcagctggctgctctgctcaggggacgccatctgttgtctgttttctcttaaagaaaccatgggatgggtgacacgtctatcaagtttgaagtggttcctgggaaaaaccagaagagtgaatacgtcatggcgtgtggcaagcacacagtgcgcgggtggtgtaaggactccttctctgctgcctggtggccgctgggcgggcggcccctggtgtggccctgcgcctctgtggcttggtctcagctgttgccctggcattgtccctgagcccagctgtgtgtgctggccaccacacgttcagcctaaggcggactggcagccgtcctgcctgcactttccctgtcttttccctttcccccgctgtcacccctgtctccgtccagcccttgtccctgtggcaggaggaaaggccctcctcctcgaacagccagcagaatcctgctgctccctgtttctggaggtgtgcgtcttggcgggagggaggctctcggctgcgtggctttgagtggtagtgtcctcagctcctagactctgagggccactctctcaaggtggcagctgggtactgtgagactcaggtgcccagagcagtggcagagtgctgcctattcctgtagaatgtgccctggctggccctcggggtgtgggtcaggagggctgggagcggcagggggccccatgagcactgggtgtttgtgaccccctctccatgcttgctctttctctgtgtaggtaagaacaagagagttggaaagcagttagcctcacagaagatccttcagctgctgcacccacatgtcaagaactgggggtctttactgcgcatgtatggccgtgagagcagcaagatggtcaagcaggtaactggccatcagcaggtcccagggcagcctgtgctgccaccctggagcgtattcctgaggctctgtgctcagagggggcagagctgggcagctctgctgttgctcacagctgcctctctcctgggccacttgtgtggctttgtgggcaggggtggggtcgtcccagctacatctcctatcccagcctgctgggcatggtcagtgaagtgtgggtgattgggaacgcaggctgggcccagctatgtggcttgtagggagatggccaaagtgcaaggcagggccaggcaggagatgctgaaggtgcgcccggctcggaggtgtgcaaaggctcaggagccagggccagctctccctgcttgaaggagagcgagtgtgtcagggtagctctccctggtaccagtgccggtccatctctaacagaagagcatatgtgtaccatctgtcttgtttctgctgttgtggccaacatcctgcagtgtaagccagtgcccactcctgaggggtggagggtaacatggggaggtgagtgtaatcattttcctcaaatgattacagaaactctctgggttcttgccctcctggtcattggaaggggaagtagttgtggaggggttaggcctgcaggtggggcagccctaggactgtgtggtgggtgggccctctgcccaagccagctgccaagagcagggcctgcctttaggtccctgagaccgaggcctcggcactgtccccgaagaggcctttactctggacatgataagggagggtgagggggctcacacgggccaccagggcatgttaaggaacttgagagagatttttgggaagcaagttgaaatgtaggtagcacttgcttctgcccttgctgtgcatggtccttggctgtgacggagggagagaaggcaagccccactctggcccgggggtgggaaacttccctgagcaggagggggaaaggtcccagccaggcacagccacagcttgggggagctctggcatcccgaggaaccacagcacccttggggctggcctaagacgggaaggggctgaggccagcctgatgctgctctgcattcatggagtgtgcagagagctcagtgcctgaggctgatgggctgggctgcagcgtgctgttcttactggctatggccacactctggtttcactccttgatgaggactctgggcaccacgagcacctcacctccctactctgcccatggcaggaggccatataagtggcgtggtgtgggcagaaaggcctggcagctatggactgcccctcgctctctgctgctgtcagtgggcctggcatcactgaggcgggccagtcagcatgcagttatgttgccacagctcctggctgtttcgtgtctgccagaccctgggcgcgcctgccttcagggtcccaggcacacagctgctgggcagcgggcaggccgtagagctacagcctgcagtcctgagcgtgaggtgctatacttcccaggagacatcggacaagagtgtgattgagctgcagcagtatgccaagaagaacaagcccaacctgcacatcctcagcaagctccaagaggagatgaagaggctagctgaggaaagggtgagtgccaccctagcgggagggctgccgggccacggccattcctgtggcacctgtggagggacagcagaccccaggacccgtgcctgagctgacaccttggaaatgcttggatcctccttccaaaatcagatacaggcttttctttgagcttcgacatgtgtgatagttttataaatcacttcagttttggttctgttgttagagagctggcaggccagcctgttggtggaccatgaaggtcacagtcttggtgggccacctgagtcccatgtcctccctgggtgtttggaggtaggtcagtgcacctgccagggttgaatctgtagggcttggtcctgatgaagcctcctaaagccaccttgggaaccccactcaaagaggggcctgtcaggctggcagtggtgtcttctgtcttcaggcatcgtctgcctggccacggcgtgacctgcccacctgggccttctgggtgggagctttcttaagtgtggcagtcccctggcctgggtgagagccccaggaggtatctgctgccgcccaggccagcaggtcccttgctgctccctggggtggggcttggcctcctggagccagtgggactgcctggtttgcccctggtcggaagaggggctgtggggctcaagggcagcaggtgcaggacatagtgctcctggctgggcctggggcaagcaaaagctgggcaagggaggaacacccaatggggaggcctggcctgtccctgtaactgcacccaaaattcttcacttcttggtacatgtcctgattgccagggaggctgcacatgttgtactctgatggcaatgcagggggcctctgcaatctcaggctggcctgccccaggccttccctgctcctcctagcctggcatcacaagcactggtgccgttggggctccagggcctcctggcatgatctgctgggctctccctccaccttgtgtcttcccgagcctctgccaagcccacctcactggtacccctgacctttgttgttctttcaggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaagggaatggctgatgtctttattctgagggtgagaggctggcaccctgtggacccttgactggccagatcccctcctggggcctccctgcaggctggaccctgcctttgtaacagctgagcagcaccccagcatggccccttccttggttgatgccctctctgctgggctgagggccaggctggccacagaggggccaactctgcccagtgttctccaccccatgcccccagctggtgcagttcccagacctctctctgcctctcctcaagtttaagtatcaaatcgaacattcttttttaaagtaagctctgccctgactcccccagccatgcagagaggcttgcagagctgcctaggcctagtttggccctttccctggcacccaggccctgtgttcagacccctggctctcatcacagaaacaccctttgttgagcagttgtttattctggccctcacagccttggctagtccacaaaggccctggggatgggcaacaggctacaggaacccacctgtcttcctggtcagggcccctggcccctagcagcaggccaatcctggtggggcacagggttctgtgccctttggctgcctacctctgaatatcctggccagcaagccatgccttccccgcccctggggccctgggagcccttcagctcctgtccccataatgggtcctgggcctaggatgaggggaaggtcccagtttcttgtagggtgttatctgggggtcctggtgtgggttgagctggagggctgtggggccccaagacccctgtgccattggggtgctccaccctctcaaacaggatgagcatctcacagtgcggggtctgcgggaacaggtccactgccacagccttgaccggccggaagggaatgcccttcacccggttagatggggctctgcagaggctgtggggggaaaaggggggcgctaaggtcagccgataggctaatcaggggctcctgtgggagctgggggcttggtagcaggcctagcccccacccaggcccctgcagacactcactccacaaagttgcccatggctgcccgggggttgcatgagacgtacagcagccgcctgaggttcttagctctccggatggccaggatcaccttggaatctgaggaggcaaacaccagctgggtccccacagccagagagtgcataacatggtgagccaccccatgtgtcctcgttcccgtgccacctccttaagcaaaagccactcacgcaagccagcacggggtgggtccaggatggccacgaggtgctgggaggccagtctgctcaccagggtgggcaccaggtcctcggccctcccgcagtggaactccacattactcaactctgaagagatggcaccgtggcctgtcagagggccacatgccctcccagcagggccagccctggggaacccctagccaaagagcttgctcacttgctctacctgtcgggcagcccccaagccctggctgtggctgaggcttgcagcaggggtggcggctgcccccatccccacccccacccacggccttgccactcaccattgtcctgggcgttcacccgggcgtcctccacagcctctgggcatagctcgaccccaatgaccctctttaccttctgaaacaggaaagcgtggtgtcgccccacccagggaggggagtacatggggccctgtgggcagcaaagaggagctgggcctggggcatgatggagtcagctgtggtgactttgagctggggtcaatgggggtcttggggtggggagagggtgccctcagcagggcaggagggctcacccgggccagggccaggccaatggtgccggtgccacagcacacgtccagcaccatgctccccgcatccaattgggcccagtcctggatgactgtgtagagcacctcggctgcgggtgtgttcacctgggggcaggcggtgcccaggatgtcagtggctcctctcctgtggtgccactggtgccccgacgcccacattcctggtccctccatcctgccgggacctccggcgcccactccccaccttggtgcccaacgtcttccctgaccccaccttggaccagccttgctgatgccctcatccagcccctggctttaaaagccaagcccgtgctaagcacagcctcctccttgccccacttggttgagggctcatgaggccccgcaggccaataggctgtaccttccctgccccagcaagggggctttgcctcccacaactcacaccggggcccctggaatcacccaactgcagctcccacccccacacctagccctccaggaggtcctgccaggcctgtctccaaaaacggccgctccaggtccccacagccttcctgcagcagtgagcaaacagtgaaacagtatttcccagcccagaggccaccatggcctccctcctgccgagcccagagcagtgccctgtggtaatgcactgagggccactcctcatcctccctgtgacaagggccactgccgtgtgtacctctaggttatcccgagtcaaatcagtgatgaccaacctctttcttacttcaccctcccctgtggctcacctgcctggatactcccccaaatctcaccgcctgagcccactgttcccatcacgtcctgatggtgcgtcaggcctccctcaacatgtccccatgcccaccagggactcatggctacctggaagaaggcgtgtggagagatccggaaggtcagccctagcaggtcctcgtggatgcaccggtccccagccacatgctccaggggcaggccctcctggctaggagtctttctgtgggcgaaggtgcaggtccttcagtgtcacagtccctgcagggacctgccccgccccactcgggctccttaccgctgtccctcctccacgaagtagaggcaggtcactccactggccctgcctggccctgctgtgaagtgctgcgctagggaggtcttcagctctgccagctcctcagggctcagcttctggagtaagtggtgaaaagttcccatcaggctgtgctgaggcccacctaggctaggcaccctcccccagcagggcccccgttgagacctgggggtggaagtaggcaatggccatggcctggtggcggcggctggtgcgcacagtcagctgcttccagtggcctgtgtacgtctctgggtcgtatgccgagtatggagtggacctgtgggaatcacgagctggcccaagtgcccacaactgggcaagcagtccccctgctctctcctctggccacaccttccttcatctggctgaaatggcaggcactccagaattcccggggcaggatcaccaccctctgctcccacaccgcataggacttcccgggagccccgtcacaggtcctcaccggatgaactcctggaaggccttcaccacctgcttggtggcttcggggatgtgcacggtgtcaaacggggctgccacagcacacgtcccgcccttgtacttgccgagccgacagcccacggtgttatcctccccatccaccccgacgccaaccagaaactcacacttattacgatactcagtctgcagggagagagagctgcaccttaccctggctgcccagcgcttgggcctggaaaccctgatttccccacaggggctggcagtcaaacaagaggaacagctgacaactatgtgatgttaccagaagaaaacacaaagcagggagatcaacaggaagggtgagcaaaagcaaagtttttcaaaacccaggataggggtttgtggccaccgaagtctagtctgacctgctggggtgatggcctgaccccctccagcgggcagcaggccttgttgtgcttgtgcctctgctcgagcagccagggcagcaaggcacggttggtgctcccgatttccctgtaagaggagcagatcggtggttggactccacctactgcccccgacccatgccaggccactccccaaatgtccaggctcctgacccctcctttgggatgtcattgtgcccactgtgacgtgggtgtcttgctggctagctcccaaaggggccgccagatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggtaaacaagtcatccctgatgtagctgtagagcccgggctgaggccccggccctgtagccgccccagcgccctctttctccacctcctccagggctgccggggctgcagggggcaccgagacggtagggcagctcagggcactgctgctctcctggccacagctctccatgggcttcgggccctgtgtggggacagatggggtgctagggtgaggactaggccctgggggcctggccccccaagcttccttatgggacacccagacctccgtcggtgcactctgcactcagccctgcccctcccccagtctaccctcccgaccccattcccgtctcctttcctcccctatcgcacctgcctcgtccccacctattctctggcaggtttcctgacccaccccgcctcctcccaccccatccccgtctctacccagcgtctccccgcactctacctcgttgtcgaggttctcactcatcgcccaggcggttctccgcctagaccagggacgccatgggggccgcctggccacctcgtcctgggcctgtcacaagggaagtggcctgtcacaagggaagtgctcagaggggaggtgctcacagagccggtgcaacgccgcgaggtcgccgccacccccggcttcgccccaggcggggcgggactcgaacctgcgatgctcaggtccgggtctcaggcttggggctgtaccgcccgcccgccaggggcccgcgccggccgctcgcttcgccagccactcttagtccgccagcgcgtgcggcggaggccgagcgtctctatgatcctggcttctggcaacgtcatcgtcacgcgccggatccaacccccaaccactttagccagctctagaggcgcgcgtggccgggacggaagtgcgcgcgggtgtcgccgggagtgcgcgctcctctggctgacgggcgggccgggcatgcgccgcgggcgttttggcgggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggtgccgccgggcccaagcggggacagggtgggcgggcggggccggggccgttatcagcggccacgtgggcggcccgcgccgccgccaccaacctccgccggcctgcaggctcggccgtctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctggaactacaggcacccgccaccacgcccagctaattttttgtatttttagtagagacggagtttcaccgtattagccaggatggtctcgatctcctgacctcatgatctgcccaccccagcctcccaaagtgctgggattacaggcgtcagctaccgcgcccggcccacccttaatatacaacatgatgcttgcgataacacatgaaaataggtgatggtttagttattaaaaccacttaaaaaaattctgtacatgtgcttcttgacgctttcagttaagagctggctacagtggtgggtaccagccttgtgtcttgtgacagtgtcacagcaccacagagactgtggcctgtcgcctacactcaggattgcaacaaacatcatgtttagttacacacctcagtgaaaatgaggttgtagtttttccctgttcaagttcatggaatccccccatccttgaagttgctttaagagtccaggttaaggttttgttgctctggggtgggagagggaagcagagagagtcattcctactgtgagtttcctatccaaggaagggggccaggagggatacctgggaaaggagagctgtgtgtcaccctttggtcacagagggtgatggacatctccctgaaaccactgggtggccatggctccactctgctgatgcattgccgtagcccctgtttgggagtagctctttgctgtggtgaagtgcttgcctctgttccctcactgcccatgtcgggtgggaggtgctcctggtggcctgggcccaggcccttcctgagggaggtgaggccagcagggtgggcccgggtctttgcagtaaagctccaggggcatcctgttggggaaccctgtgagacagtctcttgccagaatcatgttggggcagagagcagagtcgtctgagagaggcaggcagagctgtgcacagagggagggcgccagcctgagccctgagtgcactgctggattctgggtgccctggtccccagcgggaggggctgctcctgggcaggagggccaggtgttggccagggcctgttgcctgattagaggcctgggcctcttctctgggtcatctgacctcagatgacccgcccgcctcagcctcccaaaatgctgggattacaggtgtgagccaccgcgtccggtcatctaattctcttggttgtggaagtggaattcaagatgacctggagttttttgggctgctgtgcttcctggtggtgtcgtgacagaggtccttggcctgcacctgatccatgttgtccctgcagatctctggggctggggtgctcttgcacagtgaccatgggacggagtcttgctctgttgcccaggctggagtgcagtggcgcgatcttggctcactgcaacctctgcctcccaggttcaagcaattttcctgcctcagcttcttgaatagctggggctataggcgcatgcctccatgcctggctgattttttgtatttttagtagagatggggtttcaccgagttagtcaggatggtctggatctcctgacctcatgatccacctgccttggcctcccaaagtgctggaattacaggcgtgagcccccgcgcctgctctctcttttttttttgagatggaatttcgctcttgctgcccaggctggtgcgcaatggtgtgatctcagctcgccgcaacctctgcctcccggcttcaagggattctcctgcctcagcctcccgagtagctgggattacaggcatgtgccaccacacccggctaattttgtatttttagtagagagggggtttctccacgttggtcaggctggtctcgaactcccgacgtcaggtgatccacccacctcagcctcccaaagtgtgggattacaggcgtgggccactgtgccctgttttgttttgtttttttttaaaatagggtctcactctcacccaggctggagtgcagcagtggtatcatggctcactgcagccttgaactcctgcgctcaagggatcctcctccctctgcctcttgagtagctgagactacgggtgttagccatcatgtccagctaatttttatctttttgtagagatagtgtcttgctatgttgcccaggctggtccccactgagggaaatattgtgactgtaggagcagtggggcaatctccactcactgtatcctctgcctcctgggctcaagtgattgtcgtgcctcagcctcctgagtagctgggattacaggcgtgcatcaccacactcagatgatttttgtatttgtagtagagatggggtttcaccatgttggccaggctggttttgaactcctaacctcagatgacctgcccgcctcggcctccccgaatgctgggattacaaatgagccaccgcgcccggtcgtctaattctcttggttgtggaaccggaattcaagatgacctggagtttgttgggctgctgcgctttctggtggtgttgtgacgggcagttcttggagcctgaagaagggctggggcgttcgtggaggcatggggtcctgcagtgcagagttgtcctgtgtcctcctgcgcaggccctgcatgtgggctgcaggtctgcactcttaacctcacggcttttcttgcaggcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgaggagtgagtgctgcagggcgagggggtgctgtgtgtgtgtgtgtgtgtgtgtgtgtgtgtgtgtgtgtggtgtctggggggtgggggttggtgtctggggggggttaatggggggtatgtgtagtatctagggggctgtggtgtctactggtggtggtgtataggggtgtgtggttcggtgtgtgtggtgtctggggcagggggctgtgtggtgtctgaaggtgtgtggtgtctggggcgggggttgtgtggttgggtgtggtgtttgggggtgtgtagttggtctggtgtctggggggtgtggtggggtatgtggttgggtgtggtgtctggcgggggtggttgggggtgtgtggttgggggtctggtgtctgggtgtttggtgtttggggtgtgtatgtggtgtctgggggtgtgtgtagtgtctgaaggtgtgtggtctggggggctgtgtggtgtctgaaggtgtgtcggggcatgtgtggtgtctgaaggtgtgtggtgtctggggaggtgtacagtgtgtggtgtctggggggcgggtgtggtatccggggtgtgtgtaggggtcatctggtgtttggtgtctaggggggtttgtggtgtctaaggggtgtggttgggtgtgtgtggtgtctgggggtgttggggtgtgtggtgtctgggggtgttggggtgtgtggtgtctgggggtgttggggtgtgtgttgtctgggggtgttggggtgtgtggtgttggggggggtgtgtggtgtctgggggggtttggtgtctgagggggtgcggtatcgcggtgggggtgtgtgtgagagagattgggggtgttcgggcagtgtaagagcagatgtgtgaggtgcccaggcaccagcctccccagttatggtgtgttctaccctcaccaggatcttcctggggaggaaacgggaggggaacggggctgagaaggtggccaggtcctgggcgcctctgaagctacataagtagaggcccttgggcaggttcagccaagagctccagccaccctgtgaggggtccagcctggcctgcaaagaagtggcagtaggttgtcctgagtatggctggctgccagctgtctttagattgaacctgcactgcccagcttgttggcatgtttggaagtacacttgtcctggggtgtcccttggtaagcttcctagtgtcgtttgctgagtgtcatgcgtgtccggcggggcagggtccctcatcccaggtgcaggatgactgctggcaggagcctgagtggctcagcccttgagggcgatgcagaggggtgggtggtggtctgcctatgccatgggcacctcactgcacggcctggcctgccagacttccttgggaactggctcctgggttcccctccctccctgctcagcatgtctagtcctggggaagcttgcactctggctggtcctcctcctcgagccgtttgaatcatttccttgggggtcttccctgatgccctgtgctgctcccagagcctgggtcaggttgtgggttgttgtgtgtgcatcataagttggttctgggctcctgggcatctgggcagagccatctgtgtagccagcagtgtcttgtgcccatcatgggcccttggtagacagggaaagtggcagtgggtagaggctggcttctgggtaaggtgtcgaagaggctgtgggctgggtcggggcggggtgtgaagggggcatgcagggggcttggcatccgctgtggcaggctgcagtagacgagacccccccccagctcccagttcagatagtgacgtgtaggggtatcctgggggtgcatgtggcctggactgggcatgggcacctgggatggtctgggttctcagggagctgttctgaagagtggtcacctgcagggccatctccccttggggctgcctgtgcctggggagttggggtggaggcgtccattgcaggccgtggctctgtctcctgtgccctccaggcttcagtcatggggatgcaggtgggcactcctgcatcaatcatggggatgcatggccacggcccccagtgggctcccttctggcaactgccccactttctagccttctgctgccccccactttcagataggctggctctatgtgttgggttcccttaggaaagactgggccccctgggccttgtgccctgatatctgaccctgggcttctgacttcacggccagggtcagaatcaaggggatcagggttgggcttgagtgcagccctgggatacagctggggcctgctttgccagctctgcttctctgcatttctggaggtgggggtctgtgtgccaagtgatcttgaacacagctcaggagctcctcgtggagatggccttacggtcagggaacaggtgcccattcctatttaggatggtcctggttttaagtgaatatggaggattttcaaagaggtttgaataaaactcaggcgccgtggtactttgtctaagcctggttctccaaccccagactgtccccgtgttgtctgaagcagacccctcaggttggtgagcagggtgctctgtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggccaggggtgtctggtgccgggtgtggtactgatgcacgactgtgggctgggcagcgtgggctctgccgaggcaggctccactgtgccttatggcctgaacagctactgctttttttctatggtgaggaggggtgggctttctgtgttttgaggagagaaaggaagaccactggagtaccttggctttggagcagggaggcagtagccaactgagcagagtctctagcatcggccaaggctgactttggcccctgtggcagagtggcccctgtggagggaaaggccagtctggtgtgctgggggtgggggctcggccctgtagctcttcttttggaaagcctattgtaccctggccttggagaaaactggggtcttggcctcctggacttgaagtccacacttggcagtgttggagttatgggcatctgcagtaactttaaataaggagatattttccagtacgccattgggggttgtcatgtgtaatggattgtctctgcaaataccatcttaagtgtgtggtcccaactgccataacgtgccctgtcaccgtttgtcatgaacacctaccagacgtgcttactgtgaggctggctgcctgctgccatcacttgctctttcgtgccctccacctgggcctgggccctgttctctctgacctccgtgtgctgtgtcctgtctggtgactgcctgctggtttaaacaccagtcctttgtctctctggggcaggggtccccaatccctggcctgccgaccggtacaagtctggcctgttaagaactgggcaacacagcaggaggtgagtggtgggcgagcgagctttaccacctgagcgcctcccctcagataagcagggcattagattcctataggagtgcgaacgctaacgtgaactacgcatgtgaggaatccgtgttgtgcactccttatgagaacctagtgcctgatgatctggggtggacagtttcatcctgaaaccactcccccacccctggtccatggaaaaattgttttccaccaaactgatccttggtgccaaaagggttggggactgctgctctgggggatgtacttccaaagtcaactactctcaggtttgtttatttttacataaatgggaaccactttatggtctctagcatcagccaaggctgactttggtgggtccctgtggcagagtggcccctgcagaggaaaaggccagctcaggagagaaggctgtgccgactcctcatggtttccagtgccctacatgttcagagaaacgtctttggtaatgaactatggaaatggtccctgaaggtatggtctttgctctagaaaaagcccaactgatgactcctcactggcatcttgactgtgttctgtgagctgtggccctcatgctcatggactgcttgcctccagcaggttggcagggggacagtggtgcactttgcacccaagaagaggtgaagcctgtgccctatgccctgtgccgagtgaggtcctcgtgttgggagggtgacgccgtccactgcagatggtgccttgctgtgctgcactcttggtgacacccggggccccaggtcgggtacaggtgtcagttggaggctttgatgtctgtgaaagggagggccccttgcactggctggagcttccaggagagaagcccttggctaggacaggcaccccccagcacagaaaggatgtttagcattctgtatttgatttggggttccaataaaattccaggctgacttccttcatctggggatgggagaaatgtctccaagggagagtccccagcagtgagaaggcccctcggaatggctgggagacagtgccatcctgtggtggggctgtgttgcagggtgcatttgaggatgcagcttgttgacactgcaggatgcgatggtgctgcgggaagggagctgtgctgggagacagaatgcgtccgcgtgctggccccacgggaccacagggtaggctatacaaggacgcccatgtgggcactcgggccagccgtccagcccagtgtgtttccattggcttccctttggcagacaatggtgagcagaatggggtcctgccggtgctggggactgtgtgagaatgcagtgtgcttcagccttccatcccatgtctgtctgccgggctgcaggctggggagcctcctgctttctgcttcattttccttttccctgggatcttagctcttcttgaggaggaaactaggccatgggcttggcagccatgttgggtggggaggccggtgccaacctcgcttggttctctgtctccagtagtgggtctgcactacttgggacccctctgcccaggcctctgtgttaaggaaaagggatcccaaggccagatgcaatggttgacacctgtcaccccagcactttgggaggcaaacgtgggaggatcacttcaggccaggagttcaaggccagcttgggcaacatagtgagagaccctatctctacaaaaaaatataaaaaaaatagcctggcatggtggtgcacgtctgtggtcccagctacttgggaagctgaggcaggaggatcacttgaaccctggaggttgaggcttcagtgagccatgattgcaccactgcactccagcctgggtggcagagtgaaaccctgtgttaaaaactcaagggaaaagggatctcaccaagtaggcctgattccgcttcttcccactgtcagcatttggcagtttactccagggttcagctggtggaggaaggtgacagtcctggcaccctgcacagagcatgggcatggagtcagacctggatcctgaggggctctgtggcatgtgccactagaggaggcacttcatgggggaaggtaggagcaagggcaaggctggagatgggcaccaggtggcaggtgtgttgccaactgagaggctcacttgtggccactgcagagcccaggtaacgagccatctgctccagtggtgtctgctctaggctcaccattgtgccctgagacccctccactgcctcagagctaccatcagtgcttgggagcgctccaggctgcacctcctggagcagggcaccctgagaacagagcttaccactacggctgcctgggagaaagcccatcaccatttctgctgtgcagtagttagttgcattaagggctgggtcccggccccagtcctgggttcctccttccaatagccacaaccctggcctgcccaccctgaggagctgcggccgggtgcttccccaggggagcaggggcctgcaggccaaggagcctcatgcctgtgccgcagggtagggccgctcggggttctggttgcagaggagcagacactcagggctgggggcgatgggtgaggtccccccacagatctccacctagggaggggtctaatgggtctgggcttcagaacaggggacgctcggggcatgttggcgtggccgaggacaatgaccctcactggggacgctccggagcttgactgagggtctcccgctggcaccgcctcctctgccggcgtgtgtgtgtctgggggggggacccacacgaggccccgccccaccccgcccacagcgccgtcggccccggcccggtccaccttaagcggcggcggggcgggtgggatttcctgcgggaggagacgcgccgggcctatcgggcagggccggggcgccgggcttcccaaagggccccgcctcggggaggatgggggctccagccgaccgtctctcaagcctgcagctcgggccaggacgtggagggcccggcgcccgctggccgggctcctccagcccagtggcccgagggagggctgcgaggcggtcagaaggcaaacagccacgacgccgctgcggtgtcacacccgcgccccctcgtgaattccaaggggcttcagaccagaggggtcgttagggaaagggctgcgcccacagacgcccccgaggccacctgcacggctccgcggcccgggaccaggggggcctggccttcgccgtggtgcccaccacccgggccgcaggggtgcgtgggtgcccggcccccgagagccgcgggcgcccgccgggctggggtccccgaggccgcggggtcctgccccctccgaaggtcccgcgaaccggtggcggtccccgggccccatcaactcgccccgcccggtcccgccccgccgcggcccccagcgcccggtccaccttaaggggcgcgctgacataagagcgcagcagccgccgccgcccgtggggtgggatttcctccgccgccgccgccgccgccgccgcgggtcctgcgccgcgtccagcccgcccgcccgaccccggcccgaccccggccggccctgcccgcccggccccggggagggatgcggcggcgcggcgcccaggatgccccgcagccccgggacgcgcctcaaacccgccaagtacatcccggtggccacggccgccgcgctgctggtcggctccagcaccctcttcttcgtgttcacgtgagtcggcgccgcgtctgggggcacgcgggcagcgatgggcagggcccgcacagcccgggcacgggggcagcggtcgcgggggctggcggggccccgggcagtgggcgggcggggcgccggctgcaggcgatggcagtccctctccacccgctggggctgggggagttgaagcggtgtgccggcgtcccgggcaccggggtgagtcccttgtgtggggacaccagtgcgggctgggcacctcgggagtgtccaggcaggccctggcggggagcgctgggccctggcaggggaggaggccgggctgccctgggtgtggctgcagcccttccctccccatgggacccccgaggggacgtgggccacccacaaccatgagtcttctctgcaggtggccgtgggtgcctctcgggtctcctcctggctgcccgccccgggccagagtcaagttgttcccacgtaggtgtggcctggcctcgttgccacgtgcctgccccacagccactggtgacccgggcctggcccttggcctccttctcaggaagacccagtggtcatcacagctggagggcccaggccaggccacacccagggcccgatgttagcacatcacctccgtgggctggccatggtgcacaccaggacccttgaggtcctgtttctgggagtgagagcccgcgcctgcaggacactgggcccctccagcctcaacttcttcacccaagatacaggctggcttaggaccagagaggcatgcggacagcacagcctccctctgtggctgtggggtcaccccagggctccttcaggcacaaggagggttgggggctccaggcttcggttgcacagatcttcaaccacccaccccccttccaccaatctggggttgagacatagcccaggtggcacgaacgatggccacctgttccaaggtggggccacccctgagcatgtgagcctggagaggggcaggtaggggctgcctggcgctcgtcacctttgcaagagtttggggggcccccacgtgcatcgcaaggctgaatcgggtgcccgtggaggcgagagagttacctgcaggctggggctgggtgggcaccgcaggctgccaagagcatgtttaaaaaaggcctgtgtggacgggcttatttctggctcgggcaagccagtgtgttcttgtcacttagttgctgctggtgtggggcagagagaggtgggtggggggcagcctggggagcctggcctggggggacacatcccaccaaggcttctggaggggtgggcccagcccagtgctggtccccagggcctctgtccttgggcggggggtctggcttggttccttactctgtccatgcaattcagtgtcctttctcatgactttaaaagtaatgtgtgggccgggcgcggtggctcatgcctgtaatcccagcactttgggaggccaaggtgggcagatcacctgaggtcaggagtttgagaccagcctggccaacatggcgaaaccccgtctctactaaaagtacaaaaactagccaggcgtggtggtgggcacctgtaatcccagctacacaggagactgaagcaggaaaatcacttgaacccgtaaggcggagtgagccgaaatcgcaccactgcactccagcctgggtgacagagcaagactctgtctcaaaaaaaaaaaaaaaaaaagtatgttctttatggggaacttgtgaaatacagaaaaaaaaaatgctaagaaattaaaatcaaccccacacaccccccatctcctgtcctccttggagggctcctctgttcctggcgccgcgtctgcagcctggctgtgtggtggctgcagctgctggttccctcacgcgtgatgtcagagggccctttacgtgactctgactgtgaacctgacccagccctaggcatggagtgcttgggtggctcccactctgctgagcaccagtttcccctcctctgttctggggttctggtttcggcgacaccagcagtcttgaggtatggggttccctcctggggcagtgcaggccatgcctgcacccaaccctacacctggcctatgctgacctctgccggccctgctcctgggagaagatgccatgtgtccctgtagcaggatggtggcctgggtgctcacctgggtttgatgtgcagtggccacctagcaaggctaagaagccctgcttgccccctcagggcaggtgaggccacacccctgggctgaatggctgtcagtgatcctggcctcttccccgacccgccccgcctctgctgaactcctccgagactgctcagttcctgagaaggggttctgttgggtcggctggcccattgatgccacccatagcagctgtgctgattctgggtaggcaggggtccaggcggcccccttcttggggcaggccacttgtctacccgttgccccacctcctgccctgtatctggtccaggcacacaggaaggggagcaggttgctcttgtgccccgaatccctgcccttagtgcctatacagggttcccgacttcactgtttgctcctcggacgttaccagacagtgagtggccccagccccctctctgcactcagtaaacatgagttgctgccggtggggtggcttcacccatgcaccaggtgggcaggagttctgggtgtcatgtggtgtggggagctggaggcctgagaaccagggacccctccctcagccagatcgccaagggtcttgggaccagcaggacattcacacatctctctaggagggtctgggcatggaaggatgcccagttgtgaagagcaccctctcaggatggggcacatacagcagggcagtttctcagaggccctcttccttcaggaagccttcctaggattttgttgttgtttgtttgtttgagacagggtctcactctgtcacccaggccagagtgcagtggtgctacctcggctcactgcagtctcgacctcctgggcgcaagtgatcatcccacctcagcctcctgagtacctgggatgacaggtgggcaccctcacacctggctaatttatttattttttgtttttttgtttttttttagtagagatggggtctcgctatgttgcccaggctattctcctgagctcaggtgatctgccagccttagcctcccaaagtgctgggattacatgtgtgatcactgctcccggccccttcctatgtttctgggggttttgtatccccctgggcttcagaagccctttataccatggtataatgctaggctgggtcagctgctggcagagggttcgaagacccctaggccaggctcccgaccctgccctgacttcactccagagccacattgcagaatgacagggaccctgtgaatgtccgagggctggggctgcctggcaggctgccagtgcctggggctgagccaggctggcttatctctgtctggggcatctgggatggtgtggctggtccctagatcgtcctgagccctctccttgcctggaggcccagctcaggacagcagtcagaacaggccctgggccagactagccttggtgggccaggagggactgaactgctgactgggacctcatgagtctggggaacctgggagtgaaaactcagtgtgagcccccctgctgggacccaccgcatgtggcctggggtattcctggcccccgagcctcagtttccccatctgtccaggtgtctatagggattggacaggtaggtgcaggtacttcgaggcccaaaggcctggcctgacaagggcgcagcagcttctgccccgccggtcccgagcgccccacgggcgagtgccactcatacacaaacagtgctaatgaagaacctgatttaaatgaaaacgtctgagttaaaattttccattccacatttagctgtggcggacattctgcccctaagccacccctcttgctcggcggtatctccctgccagcccaggcgggacttggggcctcagcccgggtggggcctatggtggtggtgcatgtccctgcctgtggccctggaggagggattggaacctcggggctgggccccctggacctgccctccacccgtagcttggctggagccagccaggaggggctcagagggacatggcgggccagacactccacctccagcccaggcccagagcctgtctttgcctggccctccggcaggcgagcctggtgtgcaccatcaggtctgggtgggagtggagcctccccgagcctggacccagactactgcctgctaggccctgcctgtgggaatgcgtgtctttgagtgtccctgagcatccacacatggcctcccctgtccccatgtgtcctcatgcatccttgcatgtccttgtgtgtcctcccgtgttcttgcgcaccctgagagtgcttgtgtgtcctcacacttgccctatccacagaggggcaaagggaagcccagagagtgggagggccgtgtctgaggcccagagtgaggggcagccgagccgaggctggatagggctgggtgcagtgtgaggaggcatgtgtctatgcatgcctgtgttcacgcgtgttcacacataggtcttggtgggtgagtgatgtgcaggcgtgtctgcgttcatgcatgtgcaccagtgtgtgcacgtgtgcatgtctgcatgcaagtgttcatgcatgtatatgtgttttgtatgcagacatgattgcatgtgtgcatgtgtgccttctgtgcaccagaacaggttgtctgtgtgtttatgtgtgtacatgcctgtatatttgtgtgtgtgcacacatacccatgcacatgtgccctggagcatgtttgtgtgtgtgtccatgtcttcacacgtgtctgtaggtgcctgcgtgtgctcctcatcttctctcccactgagccctgagagctctgggccctggtgggttggcctgtgagctggtccctgttaggcaggatctgaccttggggactacagagaggacagttgcctcactctggaggactggaggagtgggcagcagctcaggtcccagtcagagaacccacaacaagcctccccaacccctggattagggcccatatgggccctcacaggcatgtggcaggtacccgcactgggcaggagggacccggtcacactgcagatttcccaaagtagccccacggctgcaaggctgctgtccagcccgcctggtgtgggggagtccaggctcagggaggacacagcagtaccgcctgcttgggctggcagggagctcaagtcagcatggggttcaggccccgcctgcctgatgggcgaacacacccccaaggcccccgttagggccaggaggcaggctggcagccagcgcaggtgcagaggggccccgaggcttccatcctgaggtcagcactgggaggacagaggctgcctccttgcagcccgagggttgaccaatggcactcgccgcatcccttcccagagcaggccagccccacgggcatcatgagggcctgcgtttggtttaatgctccgctgtcaacatcttgaaattctctgtaatttttaaataaggggcccgcagtttcattttgcacagactatgtagccagccttccccagaaggctcgtggagagctccacaggccctgcctctccctgggggagctgctcacctgcctgtgcccatcttgttgggccgaccctgccttaggggcctgtggtcctggctgaatggcgttgcattggaggccaggcacatgtttgagtgctgcctgtgtgccaggcagggctggggagggtggaaggaagcctgggggctgagccactgggcagggacagggagagccctcccagcagagggaggtgtggccgcagctgtgtcctcaccctggtgtctacctccacgggctgggccctggacaagaggaagggtaacttgggctcccagccccgccgaggatggctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatcagctctgtctaccaatgtggtcccctggaccggacagggccctgggttggggaggtgacaggacctgggcagggagggtggtggccaggaagggaggggagttgcatgaggggcatgaggtcagtggatcagcaggttcagcgctgaaaacctgacctctgaggtccctgggagggcctggcccagggggcaagacctgaggaccccccagtccttactgctgttgcctttcagtggagaccctcctaagacgccttggggggtcagagccccgtgcagaggggctgccttctggagggcaggtaggatgtggggtgggaagccggccctgagctggggtctccaccctgagggaccctcgctgcaggatcgcctgggcatccctcccccaatttccacagagacgtgctcaccggccacttatgtcatgattctatgtccagccacaggcccagccctcaggacagaccccacctccacccttctctgcagcttctggcaaggatggtgcacagtggtgccatgtgcagggggctggcacggccactgggcatccggggcagtgctggtcgcctggcctccttgctggggccgctgggcctctggcctagaagggcaggaagccgtccactttgaggcgcaggaaggggtccagcagggcccggagcttccagacggtggcacggctcagcaggggtggcaccagcccctcgaaaggtgtggggttcaccacgtacacgtaggcagcggtccagaccagcagggcgcccagcagcagcctcagggtcagcagcctgcgggcggcggtggtcaggggcaggggcgcgcggggggcctgggggctgggctctgccgtgcagtcacctaccagagctggcctgccaggcccttggagcttcccagctttggcctccctttctgtcggggaggggctggatcagagcccaccccgagtgtccaggctgagggcagggatccctggctttgggaaaccctcctcagacagggctccccgcaccgcagccctggccccttcctcctggacaggctcctgcagccacttttccgatgccccctgccctggacctgccctcctggagcccatttctccctctcgcccaagcagggccctgggtggggggctggtctccagacccagagtggggcgtggggggctcaccgacatgcttgccatctgcttctccttcctggctcgagtgcggcactgggcccgctccctgcgggggcctcactgtcaggaccccacaccctccacccccagcctggcacccaccccctggctcggtgctgtggaggtggggggtcaaggatgggtctgccctgtcctgaccaggacaccttctgagaccctgctcagctggcccggcccctgcccccgtgttacctgagaatctccagctggatgtcctccatctggtccagcacgccccggatgtccttcttgaggttctgggggccagaggaggtaagcacagcaggcccctcgccccgccctccgtggcctctcgcccgccgggccccgtccttctgggtgctgccctgtggggacctaccaggagcccggtggcctggttgttcagggccatgtgcatctcagccacgttgtcccacacctagggggaggtggggtcacgcctgaggagcaggacccactgggtgggcccccagcacccctccccctcagccaggcgggcacctctgtgatgaccatcttcttcctctcaaagcacaggcggatctgctgcagctcgttctgagggtggggcccaggatgggcttgggcagcatcagcagggtggccagtacctccccgctgggcccactggcctactgcacgaagacctccctccctaatgaatccctcaggcccacctggagtgctgttacgaagcttcctccccccccacagcccctcccccaggcccacctgggactgttgcacgaaagcctcttgcccctggcacagctcccgccgcagcagctgcagaggtgccctgttccccaagggctgcgtgccagccgggtcggggggctgtgggagagcccccagatcagccctaagactgcgggctagaggggcgttggctgcatggggtccctgggccctgtatttacccaggccagagcagtgcagcttgagtgttcgggacacaggggcaggaactgctgccccggccccaggagggcccccagctgctcccgaagttcctgattctgccttttctggggtggggggcagagagagggggctgcctgtcatggccgctcctgcggctggggctggggcaggggcaggggcgccaggtggtgggtggggctggggctggggcaggggcaggggcaggggcgccaggtggtgggtggggctggggctggggcaggggtaccaggcggtgggtggggctggggctggggctggggcggtgggtggggtgctcaccaggctgtggttctcctgctccagctgcaggaaggactgttctgcagagcccagcagcccgcactgaagctgggacagggctaccctgggcgaggccagggcccctccctcccgtgacaggggtgggcatgggcagggtctggtccctgagccaatggatcccccctgcctgggagccccctggttcgaccctgggtgcaggggccagccccacccaagccctgcctccaggtctccttgtctcggcccctcagtgtctctcgctctctgctcctggctggacagaaagagcccgggagcctcgccctccactgtgggcccactgccccctgcccctgggactgggaaaggtctctgggactgcactgagtgagcagaggagatggggcccaggcagggccaccctacaaatccctggcagggctggtccaggcctcctccatggctgctggaggctggggttgggggacactgggggtgggggtggccgcaggggcccagggttttcagcccctccatccctccctgcaaccccttcctgatcccaggtccaggctctggcctggcccaacctgccaccctcttactgagggggctgccccaggcaacagtcacaaaggcctgggtgcagccagggcggtcacaatgggcccctcccacctggtcctgaagctgccccgcctgatgacctcactgcctctgacccactgacccaccatgcgagttttctttctttctttcttttatgggaaggggacttgctctgtcacccaggctggagtgcagtggcacaaggtgtctcattgcagcctccaactcctgggctcaggcaatcctcccacctcagcctcccaagtagctaggactacagatgtgtgcaaccatgcccggctaatttttaagttttttgtagagataagggtctcgctatgttgcccaggctggtcacaaactcctggcctcaagcgatcctcttacctcaatatctgaaagtgttgggattacggatgtgagccactgcacccagcctagttataaaacagataatacacacactcacagtgtggattcaaaaagtatcaaacaataaaaatggtgtccaagcttttcccacctttatctcctgtccctgcagacaggagcttcctctttaagctcctagaggtgggctgccgtcccctgcccctggttcacacagaagaggtcatcctgtagcccagctttgcttttcacctaatatatctctgaggttttaaaacattcttttctagctatgtattgaatatttacattatgccagatccagtacatgccattgttatcctctgtttttttttttttttttgagacggagtcttgctctgtcgcccaggctggagtgcagtggcgcaatctcggctcactgcaagctccgcctcccaggttcacgccattctcctgcctcagcctcccgagtagctgggactacaggcgcctgtcaccgcgcccggctaatttttttgtatttttagtagagacggggtttcaccgtgttagccaggatggtctcgatctcctgacctcatgatccacccatctccacctcccaaagtgctgggattacaggcgtgagccaccgcgcctggcctgttatcctctgtttatgggtgggaaagctgaggcaggaagccctttagtcacttgccgaaggccacgctgttaacggtcggaccagatttgggtggcggaagagaactcatccgacagtagggccagattcacgccccaggcccgttccctcctgctccctggtgctcctcacaccatcggccctgctgcccctcactgcccctgagtccctgtgcccgtgtcctccttcttgaacccatcagccgtcagttaaccctcagaaagctggctcggagaagtcctcatatggtaggaagagccccgttccctcctctcccggtgtcctggcccccctgcaaggtgacttcacctcctacatcaagaggcgggtactggtctccacctctgggctctgggccggcctcggatgcacttggccaatgggctgctcctaagctgctgtgggcagaggttggcacgacacttgtgcgctgggcctggacctctcttgcttggctctggggactgtcctccctgcaggaggcctgggctgggctgcaggatgagaggccatgggtcaggagaggcttctgtcgtcccagccggtccccagctgcctaaagatgggtggacaagcccagcgaggcccccagagaaccggcccatacgttagccaagttgccggccatgtaccatcgagccccgggctgtcatggtggttttgccactgagttttggagtgtgctgtgacgtgggaggagacattgagaggcctcacaagcctagaagcgtcttaccctgacctcacacctgctggacttcgggctgggaagagaactggggccgagggcgttttcccacaggactggaaggccggtcgtggtccttggtggtgagagctggccaggctgccagccttctccccggaagcctgcagggtcccctctgatccctgcgcctctgggggtcacaccaactgtgggtctttccttcctcaccacgctgggcacttggtgagcacattctgccttgagacggggcatttctttgataacatttcttctcatttcctgcttgttctggaactcctgtcagtcaaatgttgggccttttgaattgatcctgtgagtccttctttctacctttgcttgtagatagacttccctgaacccaaacacaaacactttctctctgctttttaaaaaattggttttggggccggacgtagtggctcacgcctgtagtcgcagcactttgggaggccaaggcaggcagatcacttgaggtcaggagttctagaccagcctagccaacatggtgaaaccccgtctctactaaaagtacaaaaatttgctggacgtggtggtgtgcggatgtaatcccagctactcgggaggctgaggcaggagactggcttgaacctggaaggcggaggttgcagtgagccgagatcaagccactgccctccagcctgggtgacagagccagactctgttttaaaataaataaataaataaaaataaaaaattggttttggattttagcagtcctgtttttcatttccaagacatttccattgttccctgagctcccctcttcttgttccagagaattctgttctgctcttagggataaagtggctttggggggaggcgaatcttttgctttctgcattttctctcttgcggttcttttttgtttgtttagtcttggagcttcacatgagactcagtgctcaaatgtctggcttttctttcttttcaatccctgtttataggggagacaggcagagctgccgggcactcctctttccttgttaacttgaggaagccggacagccaggtcttggaagggaggcctcctgcctccaggcggcatctcgggctgcagggctgtggtctggagtgcggacagtaccagctcccactgctgtcctgccatgcttgttcgcagtactcgtctcctcacaccagtgacgaggccactgcttgccagccgcttgccttcttcccgccaggctgtcctgctacgtcagcctccgctctccacctcaagaagtgtctcgaaatatcttctctgcagatgacctctctcctgttctcagtgccacgtggggcctccccagcagaggcggctggacacctggccctggctgctggaggttgtttagctgccagagggtggcggtagcctccaggaccctcccctggcctctgccctgttcatcctttgccggaatgtcatgggtttcaggatgtgctgagctccgaaaccccatggggcaacttgggatgggggctaaggaaggcctcttggaggagccctgaggcgaggtggccctggggtggggtggaggaggccctgagcagcaggggagggggttgcaccctgctctctgtgtccctgagtgaatggggcaggggctgcaccctgctctctgcgtctctgagtgagtggggcgggggctgcaccctgctctgtgtgtccctgagtgagtggggcaggggctgccccctgctctctgcatctctgagtgggatgggggctgccccctgctctctgcgtccctgagtgagtggggcgggggctgccccctgctctctgtgtccctgagtggggtgggggctgccctctgctctctgtgtccttgagtgagtggggtgggagctgcaccctgctctctgtgtccctgaatgagtggggtgggggctgcacctgctctgtgtgtccccagcctgctaagtgccccacaggggccaggatgctgaggagtgagaggtcttcacagagacaggtggctcctgtaataaggaagacaacactggcttcctgggcgaacagcagggcggggtccttaggtcccactgtaggtgcccaggcccggatgagattccccagtggccctgagggggcgcccgggacaccctggatggcccagtgtcctcccgtcaccctcgcccctgggcaccatcctccttggcctggaaaccccaagctccctgacgcccccgcccctctccccgggcctgtgccggggaaggatactgctgctccgtcagtcagccatagagcccctcctcccccagcccctctcacccctccctgtggtccttgccaatcgccctgagcccgaaaaggtgggagattcttggagagatggggccctggatccccggccctggatccccatccctggggtcccccactcacggggtcagatacgctaacaaaggccaagcgccctgccaagcggtgtcctggattggggtgggcgtgggggttcgcctcaggtccaggctccgggatgtcgtgcaggacagggcgcggttgcggcgggggcactggctggaagccggaactcccggcctcgagggcggaaagtgtggccagcgcagcgtgctgggggggccatggccccgttgccaggcagcgcctccctggacgccagttgccatggaagccgcttcctgcccatgttgccagggcgtccagatggcctcgaggagcctggttcagaggggccgccctatgcccttgcccctcctccgctgcccagggatgggctgggaggacaaagaggaggagaggctgggactcccagcatggagatccgagtccttcctgctggagccaggctgcggcccagggcaggggccagatggggctgttctgctgtctgcaccgcggacttgatgttcataccccaagctcattttatttattttctatttttattaagaaagagtctcactctgttgcccaggctggagtgcagtggcgcgatcacagctcactgaagcctccagttgggctcaagggatcctcccacctcagcctcccgtgtattggggaccacaggtatgtgccaccatgcccagataattctttattgttttatttttgtagagactgggtctcgctatgttgcccaggctggtcttgaactcctggctcaagtgatctgcccgcctcagcctctcaaaatgctaggattacaggtgtgagacacctcgcctgtgcttggctgctcccgagcatatctcagaagccaggaaacaggccctgaatggatggagctcggggtcactgggccagccacagccctcagaggaccccatctctgtgccctctaacctgggctcctggcccacacccacccaggctgcctgtcaggatctgctccctctccagccctcagagctgccctatgtggagggttgggggtcccagaaaacctgggagaaacgggtcctggaaacagggtcggggggaagggcagagtgctggggatgctgggcccacgacctccctgtccctggggcttccccatgtcagaggtgaggctcagagaggtaagggcgcaccctttgtctgccccctccccagcatggccaagtcgctcccagggtgcaggcgatggcaggccatttgtctccctcctgggtgagtctctggacatggattctcacattttttatttaagaatcagagagatataagaatgtcaaggaaaaatcctctcatggacaatgcagccccagtaaatgactgtcagccggcgtgtccagggcttcaaggccccaggaagtggccatgctggggctgccaggcctctggctccagggtcactggggctgaactgtctgcccaggcccggagacaccctgcccctgaggagcccaccggcttggccagtccatcttcttggcactccctgaccaccacttaccttctagtcggacagtggagcctggggggacagcgtggcagagtgcctgatggtcggtgacaaagtcatctccaaagtccttgctggggccaagagccaggactccttgcccgtccccgtcactgccctgtgcccgcccagcacctgctggggactaggctgcccattggagaaggaaacacagtgctgggctgtgagctcctgaagcctgtctctgtgccccaggaccaggctcctgggtggagggagagaccaggggcaggtgaggaaaggcagggcccccagaatccctccatgcctgcccctcagtctccaggacttatgtgcaggtaccgtttggagctgtggtgcagttcccagtctcaccaccagatggcaccatgcccctgcagaagcagtgcccagagcaggccaggtggttctcgggggctgcggtggaggaatccacccagccgaagctctggcagggaaggggcagtgctagggggagccccctccccacttggatccgaagttcccatggggcctagggcaggggcttgccaggtagccagaagttcccttgctgagtctagggtgtctatcccacatttcacatggagacgaatcatcccagacaccccggcactgtcccggggccgtttgccacccctcccaaggggcagggctcctgtcttggggccttcccaagcatagtagccttcgggcagccccggcctggccccaggttgtcccacttgtcagtgggcagctggggctgggggaggggtcccagctcctgtccaaggtcaccattgcccctgaccagggtgtggcagctgctgtggcctgggtcagtgaggccgtggacggagggtggcctgggtgtaggcactgctctcagctaagagagagcccatctggaggaagaaccaggaaccagagggatggccgggttcccagcgtgcaggaggccagcttaagttcagtagggtccccctgcagggactccaagaggcaaaccacatggagagtcacctgagagggaatgatggaggctggggaggtggagcccccacctccaactgctgcctcggcccccacagcaggggagggcgggaggctggcactggcactgccctgggagatgccacctgggccttggtctggggaggagggctggccaggaggctgggtacggctactgctctggagtgaccgaaccatttccaccctgcttgccttattcttctcatgagggcctcaaggggacacaccagaggtttactggggacatggcaggggagggatctcagtgctggccttctggggccctgcgtccactccgcccctttctgacctgggctggggcctctgccctccccggggcctggagacagagcccttttggaggccctcaggcttgacaagcctacttcttagagccaggctgtgggctgggctgtatcctggtgggatgagggatctggggcttgggtgggagtggggctgggagcaggtggaagttggtgcctcaggctctgaggaatgggcctgggatggctgcaaagtggaggagaggctctctcaaccctgggctttggggtctgagcccagccctgtcctcaggcagtctgcccctgcagccccgcattgccatgttggttggagttgcgatgagaggtgctggggcctcccttgcctctgcccagcacagctgagaagttacgtgctgctgcccaactgtgggggtttcaaaccccgctggagcctccaggtgggcccttgggcagcagggccttgtggcgggaggaggggaccctgggaagtcagggaccaggcgggggagggagagaaggtgggagcacagttgtgggtgtgggtacccgccccttcctgaactgtgttcctcccggcccacctgactctagtcctctgtgccggctgccaggggatacccgaggccacctgcgtccccaaaagaaggtctcaccttcagagccagcctttgaggctcctgggtgacctcagcctgttacccttgaccctgagttcacctagatcaagtgggaggccgctctttgggcctcagttctcccatcctcagggagtaggtcctctgtcccctgacagcacccctcctcgctgtgccaccaccactgccagggttctgatctgtggatgttccccagggggtggctctgggctctcaggcaaccggctactgtggatggtggtttgcacgagaatagtgtcactcttgggtcctttgcttgaagttggctctgctgagtgcagcctgcagacattttcaggaaactgaatccacaggctggagccttctgcttccccacaacccaaacggcccccagccagccaaacagccacgagaacccagctgctagcaactgccagcaggaaacccactaccagccgctcacagatggacagcccatcccaggagctggccccacctccccgcccctctgctgaccaacccagcagctccttgggtgggtgtggccaccctgctgccccaacctgctcccggaccctgtgccaggaggtgcttcgcctcagcggggccttgcctcccccagagccgctctgctgcctgaccttgcaatgtcatgggtcctctgggcactggcgcagttgggtgggatcagctttggccagcaggtggggggcaggtgggtaaatcctccctctctgccatctccgcttccttcctcctgcccggcttccctgcctttttcctactctggctccagggttgcactgctcagaaagctgttgctgcctggccagcacgcaggcctgattttcctgggagcctggactaagaccctgaccagtcctcccacccaccacccacaccaccacccagctagccagcagctaggccaggagtgatcaggagggggcccaaccgaccacccacccggcgtctccagccggccaactctgcccactcagggccgtgagctggaggtgccaggagcctcccgggaggcagtgtgaggcattcttcttagtaagtcccgcatcgatgataaagggcagtatcagcccctctctgatgcgcagtgagcggctcaccatacaggggaggcgtttaatttatctcgggaactgggcgcaagttataaaaatggtaatttcttggagattcaattacatgttttcattgttaccctcgataatcaaggaaacgattttttataaaaggctgtgggatgatactgatctcaggagaggatctgggccgggtgggggctttggggacgaagaggagggcagtgtctgctgggggcaggcagggcaagtggagctgggccggccggcccaccagctcctgcagcccaccagttcctccagctcctccagccctccagttcctctagctctccagctcctccagcccaccagttcctccagccctccagctcctccggccctccagctcctccagcccaccagctcctctagcccttcagcttctctggcccaccagttcctccagccctccagctccttcagccctctctggcctcagtcttcccatctgccgacgggcccatctctggtagggagggtctgcgttttggcatgagggctgatgaagtgaggcgtgactcctgggccgtgagggtggctgcgtccctgcccctcccttcctggtgcccgagcagtctcgtccatctcctgagggctctgcagggaatagagaggggttcctggtggagtgtggacctgattttttccccaagtgatgtcttggctctaaataacatctccaggattaatgatgccggcccccaacagcaccaggtgattggaaaaagggttttatggccccgtgggtgaaattgaacttgcatctgaggtgtatttccaagatgggattttcctccctggcagaggcggcacatttcacgctaatgataatggcagctcctcgacattcatcacctatagttggggggacacccgtctggggcacaggggcagggtgtccctggggtaacctccaggtctcctaatctcagcagactctggggggctggttctaggagatgcgccctcacccagtgcagggccagggaagggggaggcaggagcccccaggggatgaacgagctctagctgggctgcaccagggaggaggctggaaggaggccccaggctgagggtaggacccggctagtgcttgcccagggacccacaggccccttgctgagcagactccagcgaggggcctggcccatcttgttgcaaagggctagagtcctgggctgagctgggcagttgaccttggatctgactctgtctcccctgaaagctgttccaccccaatgcaggctcctgcagcctagcacagcgcccagccaggatgggcaggaggaagcccttcttccgacgggctgtcaccgcgccctgcctgaggggcctcaagccccagggctcttgtctcagaactgggccgtggagattcaggaactatgggagtttgggggatcttggtggctgagggctgtgctcatggaggactccttgagttcagaagatgaggcccaccttctgcatagccaataggtcattgtcacagggacactgaccaccagcaccaacctccatcccccggcacctgcctttatcacccatttcccaggtgaggacaggggctcaaagaggggcagggttcctctgaggtaacacagcaggtgagcaacagagccagtgagggcctgggggtgtcctgccacgggctgaggtgtgcccacatgcaggaatccaggggtccgtgggccaggacactgccaagagttgggggctgggggagggaagggggcattgccaatgctgcagcccctgccctggggggtaggagggagatgcccctccgggggcccaagggcagggtgggcccatgctgttccctcccacctgccacgggtgaacctgacaggagtggggatggagcctggcatcccgagggaacctcctggagtaatcactccacatgctcgcggtaaatactgggcccttcttcccctcccagtaattgaacttatttacttttaactaagattaaatgttctctgcgagctcaagatactgactgccctgtcaggctcagtccacgctctgctcttcctgcctctggggaccaaccccaggcagggagggaccaggcagccctggagaagcacagaaattgtttttccaggaaactctgggtggataatccacttacatcatcaccactgtcaccatgagcatggccataaccaccatcatggtcagctccaccagcatcaccaccaccaccaccaccatcaccatcactgccaccaccaccgccaccatgactaccaccaccatcaccaccaccaccaccatcactaccaccaccaccatcactaccaccaccaccaccacgatcactaccaccaccaccaccatcaccatcactaccaccaccaccaccatcaccatcaccaccaccatcactaccaccaccaccaccaccaccatcaccatcactaccaccaccatcactaccaccaccaccaccaccaccaccatcactacaaccactaccaccaccaccaccatcactacgaccaccaccataaccatcactaccaccatcaccaccaccaccatcaccatcaccaccaccatcaccatcactaccaccaccaccaccaccaccatcactaccaccaccaccatcactaccaccatcaccatcactaccaccaccaccaccaccaccatcactaccaccaccaccaccaccatcatcaccaccaccaccaccaccaccaccatcactaccaccaccaccaccatcactaccactaccaccaccatcactgccaccaccaccaccaccaccatcactaccaccaccaccaccatcactgccaccaccaccaccaccaccatcactaccaccaccaccatcaccaccaccaccaccatcactaccaccaccaccaccaccatcactaccaccaccaccaccaccatcactaccaccaccaccatcaccaccaccaccaccatcactaccaccaccaccaccaccaccatcactaccaccaccaccaccaccatcactaccaccaccaccaccatcactaccaccaccaccaccaccaccatcactaccaccaccaccaccatcaccatcactaccaccatcaccaccaccaccaccatcaccaccaccaccatcaccatcactaccaccaccaccatcaccaccaccaccaccatcactaccaccaccaccaccaccaccaccatcactaccaccaccaccaccaccatcactaccaccaccaccaccatcactaccaccaccaccaccaccatcactaccaccaccaccaccatcaccatcactaccaccatcaccaccaccaccaccatcaccaccaccaccatcaccatcactaccaccaccaccaccaccatcactaccaccatcaccaccatcaccaccaccatcactacaaccaccatcactaccaccatcaccactaccaccatcactaccaccaccaccaccaccatcaccatcacttccaccaccaccaccaccaccatcactaccaccaccaccaccaccatcaccatcacttccaccaccaccaccaccaccatcactaccaccaccaccaccaccatcaccatcacttccaccaccaccaccaccaccatcactaccaccactaccaccaggaccaccatcactaccaccaccaccaccaccatcactaccaccatcaccaccaccaccaccaccatcactaccaccaccaccaccaccatcactaccaccaccaccatcaccatcaccaccaccaccaccaccaccatcactaccaccaccaccaccatcaccatcaccaccaccaccaccatcactaccaccaccaccaccaccatcactaccaccaccaccatcaccatcacttccaccaccaccactgccatcactaccaccaccaccaccatcaccatcactaccaccaccccaccactaccaccatcaccaccaccaccaccatcactaccaccaccaccaccaccatcactaccaccaccaccatcaccatcacttccaccaccaccactgccatcactaccaccaccaccaccatcaccatcactaccaccaccaccaccaccatcaccatcactaccaccaccaccaccaccaccatcactaccaccaccaccaccatcactaccaccaccaccatcactaccaccatcaccaccatcactatccccaccatcactaccactgccaccaccaccaccatcactaccaccaccaccaccatcactaccaccactaccaccaccaccaccatcaccaccaccaccaccatcactaccaccaccaccaccagcaccaccaccatcactaccaccatcaccaccacaaccaccatcaccaccaccatcatcagaaccaccaccatcaccatcactaccaccaccaccaccatcaccaccaccaccatcaccatcactatcaccaccaccatcaccatcgttaccatcaccatcaccatcaccaccaccaccaccatcaccatcactatcaccaccaccatcaccatcgttaccatcaccatcaccatcaccatcaccatcaccatcaccacacctccatcactatggtcgctgtgactgagcccatcctcactactgtcatcagcactgtcacagcaccatgctgacaagcccacagtgggtttgagggctgccattgcttgggactagttcctcaggcacaggaggctccacgctggtctgattgcattggaggggatgcctgacaaaggtctttatggggtgtgcattgtggagtggggagggggaggctcagggaggtctcgaggacttcatgccgtgggcattctccccggcccccttctgtctcagcagctccccacgcttcttgactgagctggagcagaggaagcaggcaggggtgggaggaggggcaggggcaggagaaggggcaggggcagccacaaccacctccacttaggttggagcacagcctcctggcctccctaaagtgaagggccacccagaggaggcacctaaccattctcccctccggactccacccagtgcttggatagccagcggggcagcttggggtcggggctgggcactcagccaaaggggctggagagcatgccgtgtgcagagcctgctcccatgaggtggtgagagcctgctgcactggtctcctgccccgagccttggcttgctcatctatgaacgggtgacgtggtgcctgctgcacagcaggccacaagagcagagcgacaggacacagtgaggggcggtaaggtgctgcctggtaagagagctgtgggctggcctcaaggggtagcctgtgtcctcttgctgagaatagtgggaagcgagctgcgagcttgggcccacagtggtggtcttaggctgccgtggtcacataacgccacctcccagtgcctgcggcaccacccctgggctccgcagccccagccagccgtccatgtggcccatcctgtcctctccaggcctgtctgtgtgcacccagtggagggtctcctgtctcctgtggctccctgaggctgctggtcacagagctgatgaggacactagagaccgctgcggggctgggcgggggccctgtgggagcgcagcagcctgggatctgcagctggggctgacctagcacagcaggccactgatgccacctctcaagtggcaggggcttcacagcctcccactgcaatcccggcaggcctcggtgccagggcggccccatcctgggggccactgaggacctgcatcggccacagggctcgtgagcatgggcaccccagggctcagtgggggcagctagagggagggttcagtcacctaggcctgcccagagccctgctcagggcccaggatgaactgatgggggcaacctgcaggcggtgccagcgagagtgggcgctccccacaacaggggagccacagccagcctcaccgagagcagggagggaatgtgtggagatgcaggaaacctctgccacgtccaggaaatattattaacaattaaaaattttaaatcttggtaacattcccgatggccagataattaatataagagcagataataattactcaatgattaataactgcactgaatagttttcaaagtaattgtgataaagagaatgttaaatgaaaacccatcaaagttgctgatgccctgcacagcgagggcaccttagtgctgggggtggccatgtcgactgggctgagactggccccccgggcccactgtgtcctggtggcacgtatggagtgtgaggaccacctccccaacacacacggggtgaggaccctgcacgcacatgcaaaggcaggggtctctcttagtattggggcaggtgggcagaacctgtctctcttcctgcctcactgggattgtggatgaccatggggttggctcaggagtctgccctgtgcctgcagatgttctggatatctgggctagtgttggggggtattatctgacccatggaccagtctctggttcttctattgccccagccactccaggcctttggtgaaccccctctaccattcaacttgacctgccatgttcctgagatctagcccagggctactccatccaccaattctcactaaagtgtgagtggttgcttggcactaccctaatctttgccgcctcatgtgtttattggtgtgaagccttcagctgcagggggatgaagaaggtgattccaggcagagcaggcctgctccctccacccttaggctactgactctgcagtcctggacagtggctgggagctaccaggagcccaggttggggcaggacctggggacctactgcccctcacataagccagtttctccaatcctggttccttgccctgtctgccatgcctcccagctgacaccaccgtgcggctccctcacctcatcctctgaacaggaccatcctgagttgtcacagcttccagaccccccgaagccacctggtcccctatcaggctgaggctgtccagacatggcctgccacgaggccctgagtggatatgctggcctggacaccaaggatgagggaccctggcacttcgcatctcagggatgccgggtgctcacccgcaaagacccagaggagagaaggggagaaaaagtctgaagggctcgtgaccaccctggggtcctgatggggccaggcacggtggccatacttgtaaccctagcagtttgggaggctgagatgggaggactgctgaaagcctgcctgtgcaacaggcatagaaggccctgtctgtatgaaaaataattagctgggtgtggcagcaagtgcctgtaatcccagctactcaggaggtgagcccaggaattggaggctgcagtaaaagtcatgattgtgccactgcactccagtctaggtgacagagtgagagccagtctcaaaataaaaaaataaaaaataaaaaaaaagaaggactcctggatcaccctggggccgcgcagggatgggtgggctctggaggccacaactctattctaaccacagtggtaatgatggcttcgggcaggaccactgatggcacagaaatcaccgggtgaaaggctgatgcagatgggcctgtggctgagctcagcttccccacaagatcctgcttccagaaagaagaaggcgtcctcctggtggagagccctcggagctcagcccatgaaggagggacatgtggtgcccctgctgcggctgccgctccccaagtcaccaggaaatgcagaccactgtctgcggccactgcattgcttcccttgttcagaggtcgtcatcccacagtgatggcaaagatggcagtgaccacggggcaggggagagcccagtaggcgatgggccagacaggtgcgggcccgggcagggcagatggggcgcttaaactgctcttgctgcttctttgagagttaaatgtttcaaggcacaagactttaaaaaggaggcacctggagacatgaaggccaagggtgacagcctcgtggggagggccgttgggggccttcccgatgctcggcacagatgggcactgtgggctatgggccgggcaggtgtggtcctggcctcaggttcctgtctcccacttctgggagctctgcctcccttgtggcctctgtttcaaggtcatttctggatgggcaaactgaggccccagtggctggggttgtccaaggtcctgaaggccagtgttggagcctccgggcacttggcccctgcggcccccacgccgctacccccagcccaggccctcaggtccagaacctcttgccctccagcctggggccactgttctgagagtgtgccccgaacgacactccctcattagccgagtcccagctctgtgttctggggttggagctctggggctgttgtcctctgggcctggctgctcactgaggctcctccaggggccctgccacccaccttgtgtgcctgcagatgtccttcccatgcgagcaccagtgccacagccctgaccccccgccctgcctaccccatcatggctcgccaccagcccagctgagctgctaccccgagcccaccacttccctaagccccagcttgctcctggcacctggcatcagcctgggaggggctgatgatcttgggggaggatcctgcgacaactgccgggcctgggacagtgatggaagtccaggcctccagggaggctaggaggctggtcccagtccctgctcagccattagggctgcccctccccatgttggcctcagtttccctgtgcgtagcatgggtttgcggtaaaggtgatgcactgccatggcaaggtttgttattgagggtccttggagcggggccactgcagcaggaagtccccgtggggccccctgcgtggggttggcctggctcaggagatggtcccggctgctatttcatgtatcgtgaggacaccgaatcctaccccaaggccatgagggcagaaggccaaggctgtgagccttccctacttggagacatttgccctggggagcggctgttcccagaccctacatgcctcccccacgagtgatctgcggactggggagggcactgcctacatctgccccaaaggcagtggcagaggctttgtgggatgagggtggtttgtgctctcagaggcactgggctcagccagcggctgaggtagagctggggccctccggggcaaaacatcaaaagtctctgagctcctgtccagggcttggatgagttgggattggtgctgccccagcacccaggattccccaatgcacctgccacctggcagtccctccccagggctcagcacccaccatgagtcctcaaggatttgggtgattcagtggcctgcctcgctgggcctcccccttaataatgcattcttgctaataaccttctttcctgtgtgtcattaaacacatcctcctgctggtgggtagtggagcagccggtggtggctggggaggcccgggcccccaggagagagggaaccctgggaggctggggggtaggaggggacagggctggtgcaccacctgagaataggtacaggggctccagctctgggcagcatcatgagacgcttgtggggtcgggggcggcagggcagaaaacagcctacaggggccaggctgggggctgccctcctcgtcctgtggtcactgggctatgggaatgggaatgagggcagggcagtgctagtggcccacagccctggggggcagcagcccagggatggttacaggacaaggtttgcgtaaaaccaggcttggaggccggtgtggggtgatccctcttggaggtgaaggaagggagcagtgtggcaacgtcctggaaatcatggtcagagggcccagctggggcgtgtggcctggaaaaggcactgcccccacccccaccagccagggtctttcccttgcccctgccccctcctcagggccccgccctgtcagccctgcctgtgggtttcagccccatgggcagagcatcagacttagcccgggtggaggacatggtcggtcctgcgggcaggtcgggggagtcccaggccagggcccaaggccacccgggggcagccctgcccacgcctcatctggtggaccagggagaagtcctccatcaggcatggttacaaaacttctcagacttaattaaagtcaatctccagttactcaaatgccattgatttggatctcgactgatggggaaaatatgatcatcatcatgggaaacatcgataggaaggcgctgagtacctgggcacagggccgatctggagccaacacagtcacggagcccctgctctgggcccgaccacggggccctcatgcagaacccttgtccaggcccttccggaagggtctgccacttgctgcctgggtgtccctgaattctcaccccctggctgaacccaggggcctcacagaaccgggatcctgcagggctgatgggaggctcaagggtgcgtgtcttggggccggcagcagccagcgctctgtggagaccgtctaccctcgtcacgtggctggggtcctcttgatgttgcaccggggaccctgggctggcaggactaagtctaactggggatccagggctcctgcctatcagcccccagtgagtgagtgcaagagggaaggccctttggccagtgctgcaccttttacttgcgtgggctttgaggcttggacccagcccgaggcccattgggcagcagatgtcagcacctctgtagagggcagctgaggccagacttctccatccagcctcagcagagaagcaagggcggagagcaggtagaacatcaaggcggaaggaggtgatgctgttcgggggctggggagaagtgccttcaaccagagcacctgaggttctcttctggccttgcagcctggagcctggtctggggctaggaggtgtcgcagctgtgaggccccaagtgcaggcccaggcagaggagacctggaggcagctaatgtgggggagagttgactggggatcgtaatctagttttctgtttttccttggaaaaagaaagacaaagtccccaactcacctgcccttaaaataaaaagtcacaggctgggtgcattgcctcatgcctggaatcccaacactttgggaggctgaggcaagtggattgcttgagcccaggagtcgaagaccagcctgggaaacatagagagggaaaccccctccctacaaaaaaatagaaaaattagccaggcatggtgtcgcatgcctgtagtcccagctacctgggggcctgaagtgggaggatcctttgagctctggaggtggaggcttcagcgagctgggattgcaccattgcactctagcccgggtgacagagtgagaccctgtctcaaaaaacaaaacaaaacaaaaaaaaccaccaaaaaccaaagtcacataaaatgtcttcataaatacaatagaggcaaacctcatgtgatttgtgttcatggacttggaggggccaaaggcccaacagaagtgagaggaggagggaggggaggggtgcaagggccaagggtagaggccgggaggggccagcatggtggcctgagtccactgcaggtggcactgctggctttggtgtcctcatttcatctcctgtgacctctgcccttggcatgtccccaggtacctcctgtgggctcctggctggggtggggtaggaggaggaagctgagggtggccagggtctgtgtccatcgaggggtgtccaaattctagtggagggagggctggaggggagtggggaggggcctttggccaaagccaggtgctggggtgtgacggatctccacggttgctgggaccttgtggccattcctgggacatggctttcaccttaacaagggccctgggtgttccaggggtccccatcccctgcccctgggggctcagcacacaaagcccagcctggggcctgggccatggtagccagggaggtcagggtgtgaggccttggtggcctccaggtgggcggtgagccagggggtgtggacatgtggacagtgccgggcctgggtcatgcacttcgtcaacccttcacgcctagaccacagcctctctgagcagggcccagcttgcgttgtgctgagtcttttgttactttaattaatgcccagcttcctgacgcttaattaaactggaattgctccatgtccaatagccaagcatcccattagatacaagttaatgcaactgtcgcagtggccatgaaatgaggctggtgcgtcccccagggagggatgcagaatgcatcttggaggacagcatggcctgaccgggcagctgcacacagggccaaactgagcccgtactggacagccagccctcagcccacccagtacttccacaagacccttcccaggcccctcgaggaggactccccatgggggccctggcctccagctcctctgcacgcccgagggcagcctgcttgcttcctgctgaggtttgctgttccagctccatgagaaactcatgctagtgtatcaacatttggaaaatgcagaaaaattagagaaaggaaagtagggactccccaccccagaaaggtgccatcctcccatgggcctgcgttttgggctccgtaggggctacaaggtgctctctggggcctgcagtgggggccggggcaggagctctgggaaggcgtgggggcagaggccacattgtgaggagccattggttcttcaggagccggaagttctaggatggggggcagggctgggagccagcgggggtgaggcaggctggggatgctggggtgataccttgcacccaccaatctccagtgccagcctctcaccctgatggccccgtgtccaaggcagcctcacggtgccctctgccagtggccaaaggcattgtgcctggttggtccatcaccccagagtcttttaaaattaaattaaattaaattaaattataattaattttagagatagggtctcgatctgtcacctaggctgaagagcagtggcaccatcacagttcactgcaggcttgaacgcccacgctcaagtgatcttcccacctcagcctcccaagtaactgggactgcaggtgtgcaccaccactcccggctaatatttaaacacttatttatttatttatttatttatttgtttttagatggggtcttgctctgtcacccagactggagtgcaattgtgtcatcacagctcactgcaaccttgaactcttgggctcaagtgatcctccagcatcaacctcccaagtagctgggactataggtgcaggccaccacacctggctagtttttaaagttttttgtagcgaggggctttcactatgttgcctagactggtctcgaattcctggcctcaagcgatcctcccaccttggcttctcaaagtgctgggatcacaggcctgggccaccacacccggccagcccagactcttggttcaatcccctagagggcttgagtggggcaaggaggtggcaaagtgggcagcaagggggccgccctggacaggtctccctgtccccctacccgagggtactgagcggcctctgcattgggctcccaggctgggctgggtgggtctgaggcaggagcagcctccccctggaggccagctcaggtggcagaggcccggtctgccccgggtctgcggagccgagggcaggtctctggtgcgtaggttgctgggcctggctctctctcaagcttgtttgctgtttgggtcctcctctttggggccagggccacacgcacctctgcgacattagcttggtgcctgtgaggggctgggtatctcaggagatcgcagcaggtcctagcactaccctgttgcattcttcaaggactccccgcagcccagtgtctgtggagtggggcgtgaggtgctgcctcccatgttgctgcttagaaggacgcagccctggaaaccctcactgtggagtctctgagcccctcatccgcagagcagcagttgctgctgtttgcacagacagcaaatccggggcatgtttgtttagtaagattacctctgctggggcctggcccaagggacaggccaggcacagaggggtgggggctctgtgcatactgaacacccccccgagagtggctctgtctacagccggaccactctggaagtgacggcactgcgggcctggagggctggggcagtccaattgggcaccatgccctcacaaacaacacacacaccagcggtggggttgcgagggggcgctgagggaggatcctggctgccctgcttaagccctgcagcctgtggggctgtgtccacccgggtcgcatgttgcttctacctgcacggtggccccaccacacaaggtgccgtcctgccctccagtcaacttcctggggctctgagcagcctgtggtggcacctcacctgggcagagggtgggaggagcagcgcccttccttctgtgcagggagtctgatcagggttctgtctcactgtgggacagtgggggccggggaagagcggcaggtaccaagtgcagacagcagatgtagatgcatgcgggggtccgggctggggccaagaacacagccctggagtcagggacaccggcttcatgtcctcactctgccattcaagagctgggggacctcgggcaggtggtgtaggaacagggaggagtctgcctgcagcacgcagaggagggctgtgctggtcagggggtgttttggggagaggacctcaaagggaggttgactttgggaaaggggtcagagtacagaaaaagtgggtccaaatcctgcttcagcactgagaccctgcctcggcaggggtctccaagcttggctccaccccctgaggggccagttactgcatacctcgcccacccaggagctgggggccctggtcctgtttcccagggagctgttggcacttgtgggctcctggctggggtccaggtgggctctgctcctctgccctgcccagcgctttgtactgagcccatcctgcagagactcaacggggccaaacgcacattccttgaccttctgtgagtctgtcagtcttcatccctccctggacctaggaaggcctggacagctttgaccattggtgttgggtggacatggcgctgcgctgcaccccaggccctcagagcccagctgttctgctttctgcttttggtcctgagctgccttgaaggaatctgaccagcagggagagcccacggagcgggagggcctgtggggctcagccctgcagccggtctgccgaggccaggcctgggggcacagctggggctgagtacactgaatgccccctcgatgccatgcacagcagaagagctgcccacaccgccctgctgggccctgcccgggctccagacccacagaccaagcacacaagagactgggctgctttgtcatgcagcagcaggtagccggacacatgtttccccattcccctgccatcctctgaaatcctgtggggagaaagcatgtgaggtccagtgggggttggggtgagggtctgactgggggctttctaacccacgtctgagtcccatccggcgccagtgccacagtggcgggtgactggtgctgctcacactggcaagctcctacctagactttggagcccaactccacaaggcccctgaactacccctgtaggcaccgcagcccccttgccttcctctgctacgacatcaaccactctgatggtatttgtggtttgatgtgtttaagtaaaaggcttgttgcagagtttaattgaccccatatgtctgcctgaggaggccgtgagctgcagagggcaggtgtgagctgggctctttcctcagtccccatgtcttgctgggtactcacagggcacacacgagcacgtgcggcaggggcaggggccagcgggggatggggaggcttggcgcccacggccccgctgccccatgtttccactgcagccgaggagaaaacgaggactttacggctgtcacaaacatttcatcttgtgcattttacagtccacgactgctgtgaacactggggctcctgtcggagctagaagattcataaaatgcatgtgaattattttattttattttattgttttgagatggagtctcactctgtcacccaggctggagtgcagtggcgcgatcttggctcactgtaacctccacctcctgggttcaagcaattctcctgcctcagcctcccaagtagctgggactataggcgtgcgccaccacgcctggctaatttttttgtatttttagtagagacggggtttcgccatgttagccagactggtctcaaactcctgacctcaagtgatcctcccacctcggcctcccaaaatgctgggatcacaggtgtgagccactgcgcctggccaaatgcatgtgaatttttatgttcaattattccaggttccctgctcggggcccatgggcttccccatgtacaacccaccggtaggtccccgcccagtccatgctcctcaaaggccagcctcacacccatcccacgtcctcttggctggtaaacactctcccccttcttccttctccctccacatctcaactgctggaagggaagagctcctcagtctacttggagtccctcctgcacaagaggatccagggtggtccaggagggccaaacccacctctttgggtgcacccctgggcagtggattggggatccagggcttgtgggggtatgcacccaccagggcaggtccctcaggctcactctccctgcgcctcagtttcctctcctgaaaaatgggcttgtgactaaatgttgcagggagctgctgagaaaacgcctgctgaaagcttggcaggaggtcattgtgaccagggatggggctgggtgcttcggtcaggccagggctggaggcaggggctcacactggggtcagcagtgcaggggcgtggctggcgtggcaggcgcatggggattggctcatcagttgcggcctcacgtcccttcgttatggcgcctgcagaagatgttctctgattagtctgctgaattatgaattaggttccgggtccctgtgcagctgttcccggcttgtcatccccaccactttatttccccatctgtttataaaaccaggagcgccgtcctgcaataaacacttcaaacgctttttttaggggctaattaattgtgttgcatttcttcgacacagcatgcaggccggacctgccccgaattcccaatgcgggtgtggctcctgctgagcgcctggggagggagccaggcctggagcctggggggctgcatgtggccgccccaagtttgttttctccaaggcagccctccacctttatgtggcgggctgggctgtctcaggaatgcgccggccatgtcaggttccccctagattccccctccgcaccctttggctgaagtcctcctgctcggaccataggacactcttgaaattatctgtggcacatccaaggtcaaggtcacgccctgctgccagctacagtgctgaccctgagggctccacctcccaggcccactgagcatcacgctgtcttccctgccttgcctgcccagagcacctctgccctccaggaccccctcagcgagtgcggtgggcgagtgcagtgggtgggtggcccatctaggcaagccaatctctcctcggatccgtgcacctctttggagaaggcctctgggagccccagccctgctgtgcaccctgaggcctcactccgtctgaggaacccagagagcatcgcggaggaggcttaaaacaatgacaataagaaaacaaaatcacaatcaccaagtcacgaaacagctcagaggcaattgagttaggcagccccctgccagtgcccaatgccggtaaagtggctctttaggaactgagtcctaatgtgggctgcgcagcgggtcagaggaggtgttcagcctgtggccaggcattggggccccaagccagtcctccactgcggacagaaccttgcccagctgcagctggagcctgaaggcatccactgcgtgcatctggaggggtcgggggttctttgtccccaaggccactgtggctcctgtgggccaccgtcatgtccactgggactggtgggaaactgggtctggggacttgtaccctccgcttcctcatgtcctcatcctcaggtgccctcccagcccttcaggggtcctgttttccagctgtgggcaggatgttgctcctctgccctgtctgtccacgactcagggtgccaaggctggtggagcctccctgcagccccaagggaggaggctggggccagagacgccctggggtggggcacgtctcttcccagtgaacctcagatccctcgggcgcccacgctccccactgagggcctggggccacagcactctgcctgtgaggggtgggcccttggaggcttggggacatgcgcgcccacaggcacgtggggagagcctgctgagcgctgtctcagtgatggttccccacactggcccctgacatggggcttggtgtggcagcttgttggggaggtggtgcgtggagcaggatggggaccgggaggtggttgctgtgggctctgcggggcgtgagggccggtgtttgccccaagctcagtgcctgcctgtgaccacaccagctcataagtgacctctgggtggcccaggggtgagcggagaggggacctgagcaggcaacacgggcctggagaggagctttgtctctctaggagaaggcagcctgtcctgccagacctggtatcacgccaccccaaggcaggccccgcagagccctcgggagctccactcggagatggagacgcgcttccctgtgtcggggcttcgctcagaacatttttatgggctgttaattgttatgctttcatttaattctgggtgtcattccatgtcagccaagcccgacaggctgggatttatgcttccaaattatggggctcgggctgttcagaggtaaaacaattacccatcaatcagccaccaaccggcttgtgctggggctggcagccccattagcgggcgtgggcagccatggcccagcaagaccccttgagggacaggactgccttcgagggcaaggcagtctgggtgaagtctcgccccaggttggccctgtgctgtggcagggcgcagctctctggggaggcggccgctcagggaaggaccccagggtccacattcacacccaactggctccagtgctgcagccctcggcctcccatatgatggtgtgaccctaggtgggctgagggtgacccgccggaagacgctgcagcatcaaggtggggggaccatgggtcccatatgctggggcctggggagccttggccagccatggtcactcagtgggaggggcagggtcacctgcctcctgagcaccccatccccaggagggagggaccaggtgtgacccacttcacagggagggaagccttggctgtcagaggggacactgcgtctctcactgggaggacctcccggcctgggcttgaggcccacctggatctgtgcaaacgtagatgtgggtagggtggggcaggggaggggaggtgggcaggggaggtggagtgggctggctgtcagctcaggagtgggggtcggggaacctgggccacagagcggatcctgtcccaccttgaccctggtatggttgagtcggcggctaagccaggccccgtggtccttcacccagggagagcctgtgccaggccaggcactgccaggccagcacacagccttgactgagcgcctccccgtctcaagttgtctcctggatgcccggctggctgctcatggggacaggggcaggatgggacagcgagaagaggtgggctcccccagccccagtgaccctccaggccagggattggcttctctccctgcagagatcgcccttccctgcccctctgcccagctgccctgggacttgtgtcccagccctgcccagcattcatcctgggtgatctgcacgtgggcatggcgcctcaccgggtcagggtggtgtccaggtgagcaggcggaggactctcctcactgcccagcagtgtcctgctcccccagctgctctgacagccaaactggtccccagctggggcatctcacgcccagacctgctgcccgttggtgcagtgcagcccccgccaatgcagacactgtacctcggtctccgggaccccctctgcccctgcaattcgacgctctgctcctgccctgctgggatcccacgtccctggaccctccctatggcagtctcgccccgcgaccctgctacaggcctgccctgccacccccgggcacactccctcatccagagtctgtgcagtcacatgtggacccctgaggccggcctgcggctccctgctcacgggcggctaaaagggggctttccagtcacgccctgccctggccttctgcctaaggccctggccctcatgggccaggcatggtcctcaggcccttggctctgccaaggctctgagaccccaccctagagagaccctggcccacccagcctggccctgcagcagtgccccaagtgcccccgagcccggcctggctgctgccagggtgaccaccaggggcagtagtcagatagagggcggtggccgggcccagtgtgtctgggtgaccgcagggcctgaaggtgtggtggcccacccgggtcagagtgaaactgaactcctaggtcagggtcgggtcctcccagggtcgtgtcctctggaacttggggcgagtcactacgcctcagtgtcatcgtgggcagaaccttccacatgtggcattgaaatctttcaaattgaataggaaaagccccacgttttctgagccctatatatagaccagtactgtcctaagtgtattctagggaaagacagtggccagccctgtagctcagttatttctgtttaaagtgtgaacgggctgggtgcagtgcttgaaaatcaagcatgaagtgaaacccagtgggccgtgcatggctctgacacccatgagtcattcacacgatgccacttgctcattgctgtcccaccccaaatgcagcactggtgggcgagaccctctgggcatattacctgcgggatgtggctccagcgcctcacttccagctcactgctgcctcaaactcctggactcaaggaatcctcctgcctcagccttctgaatagctgggactacaggcatgtgccgccacacccggtgaattttttttttgtagagaggggttctctctatgttgcccaggctggtctcaaattcctgtgctcaagcgatcctcccaccttggcctcccaaagtgctgggattacaggtgtgagccactgcacccagcctcttcaccctttaaacagaaacaacaactgaacatacagggcagaccagtgtctgtccccagtgcctgtgctgggggtgactttccagctggggctcagcattgcgagtgggaagacctcctggggccaacatggcttggattgtgagggcacgtgggtcgccgtggggccagagtccagcagtggcagagctgcacagcagtggggaggggcagggcagggcagggagagggccccggctggcccggctggcccagcctgcccagggctgcacggtttccatccctgtccccagctgcagtgggacacctgccatgggggaggctgggggaggcctggggtggcgccttgggctctcagccaggagttcgctctctccaggtcaggctggcagagcagccccagggcccctgcacccccactgcccatgcccaccttgggctctctgatgcccggcagggcctctgggcttctccctcccaagcttgggtggcaacgctggcatttggagcctggggagctgctgacagtgctggtcctgcccgcgaaggaggcggtgccaggctgtttggaaatgtcaggctgatgggtggtggcactgcccagcaccccacccccgctcccaccccaagaggctggacacgggctggggccccggtgatggagccaggccgggagccaggagatgctgctgagcagggatagctggctgagggctcctgggcggcaggggatccgaggctgatggacaaggggcctctccttgccaccgcagctgcggccttggtgggccggtcgatgcggaagagtgatggtgcacgtggggccgtggggtgtcggagggaggtttattgatgtcggctgatttccctgggggccccttgctggcagcagccaccatgctccccgagagctaaccgtatcaggccggaagggtggtgggcagtgtgatggatggactccggctgtcggctggctgggcctggatggagccccgagatgggcacactgggccgtgacaagagtgccgtggggtccctgggggagcccaaagaggcctctgagagggtctgtgctgggaggtagacctgagagaggggagacaccatcccagggtgggcacaggcatggggcagagggcacgtgacgccaacctagggccccagggggtgggacggaggggcctggttctggggcattgggagaggcctgggactctggacctggtctgtctttcttgtccccagtgtgagcaccagcccttgcagctgagccctgggaggcgcctcctgcccacgcagcaaagctcagagctctgtggcctcctctgggctcctgcacagcgggtttgctcccagctgctcccctgacacggacaccttcaagggccacgtgactgccatccccaggccttggccctcgatgaggaagggcccttctcaacctgtggctctgaaataggtctcatgatggtgccagtttaatgacaggagcagtggctaatccagtggtcattattgcatgggctgtcatgcccttctctatccgtgctccctgaagaggcgagggtccactgccggctgccacacagagaagcatggccacagaaggaggctcctctgctctgagtgggatgttggctcctcgggccacactgggctggaggacaaggggaggcaggggtgggagggccctgggctggggtggatggggtgggcctcacagatggcatggccctgtggacagcgagtggcttttcctccccaggtctcgtcctgagccctgctcctcctcctggcctcccctggccccacacctctcccactggcttcctttcctggcctctttctctctgctccttgtctccatctctcattcctctgggccttgcttcacggagtcaccagcccgtgtgacaatgtccactttccctggcctcatgtctccaacttagtgtgggacctgcctttccaggctctttggccacatgagatcatggaaacacatggctgctgtacccacgctgacctggctcagccctggctcatgatgcttcctgtgcaccctggtcccatctgtacctcagtttacccatctgccacacagggctgagggcatctgccttgtgtgtggcggtcaggctggcccagtgaccgccgagccattttggcttcctcaggtctggccactgtgaaggacatggctgtgccccccgtctgccctgtgtggccctgggcacattaaccccttccataagcctggtctgcagacgagcgcccaccgggctggcagtgcctgaagagtctcgggcgacgtccactcacctcccaatctggtcccagctctgctcaaactcagactggaggatcccccagggcagtgactccagttcagagtctagctgactgcgtccctggcagccaggcacggcccaaggtccagagctggagactgacccccctgtgtaggacctctgggaagtccccaggacccaagacggctcagggctagtgaggtagggacaggtggctatttcaagcccccagcgggcttcctgcctggggcacctgggcacagtggagaaagatggctcccggcagaacacatgcccccatccttcggggccagatgccttgggttgggcacggagcagggcccccagcagacacagaggccagggtgggaagggccagggcaccgcgcagtctcttgccctgtgtcagggctccaggcctatggtggggctgggcctacccaccctgtcactttccccatacggctttggggtcccaggggttcaggggcccctcctgcctgacccagccttaactttttgttgtttcttctcattacaaaagaagcatgttcaaaagaaccccacagtcctccatgaaccccacagtaccccgtgaactccagagtcctccatgaaccctacagactctcatgcaccccacagtcccccatgaaccacatagtcccctatgtaccccacaagctcccatgtaccctatagtccccgatgcaccccacagtcccctatgtaccccacaagcccccatgcatcccacaggcccttatgtaccccacaggcccccatgcaccccacagtcccacatgcaccccacaggctcccatgaaccccacaggcccctgtgcaccccacagtcccacatgcaccccacaggcccccatgaaccccacaggcccccgtgcaccccacagtcccctatgtaccccacaggcccccatgtaccccacagtcccctatgtacctaccccacaggcccccatgcaccgcacaggcccccatgaaccccacagtccctcacagcccccatgcggggaaagggcctcacttctggccgctgactgacttgccagtttcctggagttctttatccaactttcaaggttgctgagtcccgggaacacctcagaaacctcacgaaacagtgacaggttgtcaatcaagcagcaaggttgacatgtttgagcaacgttcagcctgggaggcgctggggccaattagcagagactcccaggtagcagagcccccgggctcatggctggggggtggatggtcagccctgacgctgctgcccccacccgaggatttctccccagccatggacttggggctgagggattcctgtaccctcccggccacctggacagggtccccgccgtggcccggcctagggcgttggctcagaccacacctgcccaaggatggagcctgacacccaggaagcagctccttgcagcgccctgggcctccgtggggcccctcttggcagagtgacctggggaccaacccccttctgtgaggcaggtgaggatgctgccttgtgggctgaaggccaaggggaagaggcatactggggccactcaggctgagcagtggtcacagcggccacccctccctctccaaggctctggcgaccactgttctgtttagcccctacccctccccaccttttaaaaagacagggtctcgctctgtcacccaggctggagtgcagtgacacaatcagagctcactgcagcctccaactcctgggctcaagcgatcctcttgcttaagcctccgagtagctgggacaacaggtgtgtgccaccatgctcagataatttttttaaaattattttttgtagagatggcggtctcactttgttcctcaggctggtctcaaactcctggcctcaggcaatcctcccttcttggcctcccaaagccctgggattatgggagccaggttcccaaacactctctgctcttccctccacctggcatctccctccccaaagctctgccccatcctgaagtccccactgcagatgctgcccctcccagaaggtagctgggcatgggctctgcagctgcagagttatggactgggcctccctgggcagcttcctgggagctgcaccatgcacgggtcacgggaccctcctgggtaggttgaactgggaggcgacagagacccttctaaagtccctatgccgggtgctgggctgtagtcacatggtgccctccccaggaatccctgaggggtgggtgcgtctctctcagcagcaccagcaaggaccagcggggaggggtgagcatctttgttctgtccaagagcctctttggagcacgagcacttgccacatgcaggagagagccatgttcactttccttttatggctgagtttgagatgtctggatagagagttatcagccaaggcactgataaggtctgcggggggaatatactgtaaagggctgagcgtggagtgggggctacctctcctgctcgggctggtgttgggggttggggtgggctgggtgaagctgccactcctggcctggatatatggagccctgggcagtcctgcctgtcccatggctttgctggacacaacaagaactgccagatgtcatttgtgtgggaatcattttgctgtttgagcgaagttggatttgttagtgtgctcaccagtgtggatggatgaggtctgaccaggaggctgcctgttgtctgtctttcacagagggccctccacacccagggtagagctggggagaaggagtcctggggaaatactgagttaaacaaggctgatgtatcctctgcaggacttctcagtgcctttagcatggcgggtgtaggtgagtctaagagatggccaggtagcctaggtgtggatatcaccaggctagggctgctgtctgtctcctctgctcacgctcctgtgcagggagggacttgagggtgggcctggggaaactgtggaaagtaggagtctctgtccccagacactgtctctgaactggggccaagattcagtcatttcatgtccccactaggcagtgcttacagatgttgcccagtatcagctgcattgattaaaggaagagctttctgaccatcaggtgggggcgctctcctggtgagtggggctgggaggcagagccctgtcctccgcggtgtgactgggacgtaatcccctcctggggctgagtggagcaggggcttgcgcctcccgcaggcctagctgtgtgggatctcatggcactctgcttttattctgtttgctccaataccttctgcttgccacctgcgatgcttattttccatttccagtggtgctgtaagacttcctttcaaaatataatcacttaagttaaaaaagcccattcgaagaaagccctcgagtaaacaatagtggagcaggtgggcaggtggagctggcccttggccggtgtgtgggctgggggcaagtgggaagggacaacgtgggaaggaaaggggagcagggggtgtggggaccctccctgggaaactcccagcccgccctggcctctgttactgcctggccctgctgagctccctgggctgctgtctggtggccaacactggcgttggctgcccacatgccatggggtctgcacacagcaggggctgggggacagcgtcacaggaggaggaaggccacctgtcacaggagaaggaagggcacacagaggcttgtctgagccccacgtgaggattaacagaggggatgcattgcagtaaagagcacgaagctgctgtgacctttgcctctgaccgccccccttgcagggccacgcctgcacgtagcctctgggcaggtgccatggggtctgccaaggctggcattggctgcccagatgctgtcctgccctgaggttccatagtcctccggccactgtggcctcacactgtgtccagctatgctttttatttacctgttaacctcccagcatacttattcatgataacagtgacagggaatggggcgaaagtctgaagtgtccttcaccagcaaggggctggtggaaaagtgggactcctgtctgaggccactctgggtggtgtctgtgtcccaggactctacagccaaacccaatgcagctgggggccttccatccacagacccacatgagcagtggtaaggacctgctatattgagccagctcctcacacacgccctcttcccagagggtaaactgaggcccaggatgttgcctcttgcctgaggctgcatggctgggtggagccaggccctgacctctttgcttcttcacctgcccagggcaggtgtttggatgttgagtcgactgatgccccagggcgccaggccctccttccatctcacggtccctgcccctgaggcccgtgtgttggggctgggtggaggtggccctgtctcctttccaggtgagtggtgcgcaccctggtgagcaaggaccccaggccctggctgcagggcctccctgtggctggaggtgtcttccacacggccagtgtccggcacgagcactctggggtcggacacttgagatgggctggaaggagggggcatagagccttgcacagacaggggcagctcaggcctgggtttgaatcctgacctaggcaccctgtggtgaggacagccacaggctgaggacactggtgtccagcatgtgcccagctgtcacctccaccctgggtttggcatggggctggcagcaggcccaggagggatgggagtcagagtgtcagggaagcagtgggaactcgggacactctgctgctccatgggaacagcattggccctgtggtgtgggcagcctcagcaactgggcaggggctgtcagagcccaggggatgctcccagaaagtgggatgggagcccagagcccacagcccctgatatcactcagcctgggagcaggcccactgcctccaccgtgcagacgaggaaactgaggagggcccttgggtcccctgcccaggcctcacagagagcaggtgacagctggagccaccccaggcttgtccacccccctgaagggatccccaggtgcccaccctcttcctgccatctgggggcatgactcctactgctgacttgagagtgaagctaccgccaccgcctccctccacacctgggccagcctgggccatgccaggggcatgcctgcttctggccccatgggcctactggtcttgaccattaaaaagcatgtgttggggctgggcgcggtggctcacacctgtaatcccagcattttgggaggccgaggcaggcagatcatttgagttcaggaatttgagaccagcctggccaataggaagaaaccccgtctttactaaaaatacaaaaattagctgggcctggtgcctcccacctgtagtccagctacttgggaggttgaggcaggagaatcgcttgaacctgggaggtggaggttgcagtgagccgagactgcgccattgcactccagcctgggcgacaaagtgagactctgtctcaaacaaacaaacaaacaaacaaacaaaaaagcacgtattgggactacagtcaatgataatttattgtgcatttaaaaataactaaaagaggctgggcacagtggctcacgcctgtaatcccagcgctttgggaggccgaggtgggcggatcatgaggtcatgagaacgagaccaacctggctaacacagtgaaaccctgtctctactaaaaaaaaaaaaaaaaaaaaaaaaaaaaaaaaaaaaaattagctaggcttggtggcaggcacctgtagtcccagctactccagaggctgaggcaggagaatggtgtgaacctgggagatagagcttgcagtgagccaagatggagccactgcactccagtctgggcgacagagcaagactccatctcaaaaaaacaacaaaaaacaaacagacagaaaactaaaagagtataattggggtgtttgtaacacaaagaaatgatgaatgcttgagataatggacaccccatttcccctgatgtgacactaaccattgtatgcctgtatcaacatatctcatgtaccccgtatctcatgtaccccatagatatacccacctactatggtcccacagaaaaggcatgtattggggccaggcccaatggctcacacctataatcccagcactggtttgggaggccgaggcaggaggatcacttgaggccaggagttcaaaaccagcctggacaacatagcgagacccccatctctaccaaaaacaaacaaaacaaaaaaacttagccaggtattgtggtctgcacctatagtcccagctacttgggaggctgaggcaggattgtttaagtccaggagtttgaggccacagtgaggtatggttacaccatgggtgacagagcaagactatttctctaaaaaacaaacaaaaaacaaaaacaaaacacaaaaaagcatgtgttttcctgttctcccaccaccccacggcaaagacagtactggctattgacacaaaaggtgtgaaacgcccacatgctaaggaagacagaagcccccagaatccaacctgggggtgtttcagaagtgctgaaagggaacagtgtggtccctttaaatgatacgaaagagaggaagggggctgggcgcggtggctcacgcctgcaatcccagcactttgggagcctgaggcgggcggatcacctgacgtcaggagttcgagaccagcctggccaacatggtgaaaccctgtctctaataaaaatatgaaaattagccgggcgtggtggtggactcctgtaatcccagctacttgggaggctgaggcaggagaattgcttgaacctgggaggcagaagttgcagtgagccgagatcaggccattgcactccagcctgggcaacagggcaagtctccatctcaaaagaggggaaggaaagtgctgggtagaggaaggcatggtccctggctagggttccacccccatggacctaggtgaggacaggcatttcctgcccacatgttgtggcatttcccaagactacccgggcctgccatgctccatcttgtgcctataaaaacccctgagaccctagtaggcagatactctagcggctggacattgagaggagtggatcagtggaagaacgcacaagtggctggacgtcaagcggaatccacagacaggcactggcaggcctggcatttgtgaagccggctgcggcagaatgatgtggagtttggctggggcagtcgtaggagagctcaggccgcccaggggaaaatcatctcccttctggctcccccatctgctgagagctacttccattcaataaaaccttgcactcattctccaagcccacgtgtggtcagatttacacaaggcaagaaccccaggatccagaaagccctctgtccttgtgataaggcaggggtctagttgagctggttaacacaagctgcctatagatggctaaactaaaagcaccctgtaacacgcccagtggggcttcacgagctgtcaacatccacccctagacactgccgtggggtcaacaccccacaacttgcccgtctgtatgctcccccagaggtttgagcagcagggcaccgaagaagtgagccacacccccattgcatgccctgcgaaggggacaaaggaacttttcctgtttcaggggaatggtcctcactgcctcctccagattttctgccctgagttgtgaggacagcacagcttgggctctgtccacagcttttactgggagcctgaggctccgtcactcactcggctgctttttcctgtgctggatgaagcccaggagctggctgtgcaggtgtgtctgggatttcatgggcatagatgactccaggacagctccttaaacaccaagctcaagcaggtattgccagctaaatgaggtcaattcctggcagtggatctcagggcgccggccttggaccccacctgcttgcccacccccagcaggcagagacctttctagaaggtcacagatgctgctgcgggatggatcgggtcccaaccctggctgggagtgatgcccgacaagctgctgtaattctcaattctgctccggaggccttggagatgctgcaggcgggcaggtggggttgggggtcagcgtcacaggaggggaaggccacccatgggggcacataggggctagtgtgagccctgcatgaggattaacagggcatgcattgcaatacagagcacgaagctgctgtgaccttcccctctgatcgctgtcacagggcctagcctgcacgtagcctcctgggcaggcacacccctggacccctccctggtgctctgctggaggccacgctgggctctggaatcttactgcacagagctcctggagacccaccctcaacccttgggccccctcttccttcctgggtcctggagggggctgttagggggcatgaggccacgcagcccttgagcacctactgtgtgcaagggcctggcgtttgtgaagcaggctgcggccatcctgggtgggagtcagggaatgggggtcccggaagtgctggcttttctggtggctgtgggggatcagggggccttgctgtgtatctgtgagctgagccatcctctgaggggctgagcgctggcaggaacctatcacgtttcccaggggcagggttgggcatgagaagccctatcctgcctctcagctaggccatgtttcataccccacagatgctttggaggtgacagatctgggtcaagactggccttcctggtgaccagccttcagatggacactgggcggcaggtgttcctgggctgccatggctggtctcctgtgctggtccccagagcagccttcctctcccctccccagacaccccatcctctgccgaggcctgtgagcacctgctgtgtgcccaccttttgcttaaaccccaggacggccttacccagatggggagccttggttggattgaaggggcttgctggaggtgcagggggaggggaggtcagagcccacatgcatcctgagctccctcatcttccacaccccatgctcatccccccaacctggccccgatgctatcagcccttagctgggggagggcggaccccggggacctcagaggcagggctcctgcaagcactttgctgcacatgtctctgttcctgaaaatgccccaaccccaccagggcagcaggcagcagggtctgtgggaaagtcaggagccccgctgatggtcctgaggggccaccccagcctcaggaggaggacctgcccttctcagggccctgctgttgctccttcagctcgcctcctccatgctggcctccgggctgctcacacgaggattagaggcaggaatgaagaaaaccaaagtcagaccactaccaggaccagggtacaagagaccaggcctggacaccacttatggctgggggccttgggctggtcagcgcctccccctcaaggcatatacacagtggatcggtaaaggctgtcccatctggggctgtgtcaggcctctgtgggaggaggcatgtggcgggcccagctcagttgatggattcagacccatgcatttggccagccctagtcagggaacattgcagccactgcctgcccagcactgggcaggaggaagtgtcctttctaagagtggagggagctcctgctctcaggcctcagaaacgaggtgctaagggggctttcaggcagcagcctcaggcaggaggagctcccgtgccatgcgaatggctttgcccagacaccgggtggctcaggcaggtcactctgccttctgtgtcctcctccttggtgggctggtgggctgagccaggagtcgggcttggggcctgttccaggcttgcaggcaggaacaggcccgggacaccccagagacaatattgatgctgtttctgcccaaacaaatgccagctactaattccggtctctgttggaaacacagaaatcaatgctcacagaacagggaggctggccctcgaggagcagtgtggtgttgggtccccaggcagtgattacgacaggacaggcaggcaggagaacagagctctcgaccttagacacgtcccatgcggccctcacctggcgacctggactcggcagcacgttgggggtcagaacagtgggttctcagggacctggcctcggggggcacccgtcatccctcagcaccctcccctgcaaaagggaagcagggcctggacatgacccccaaccctggctcctgccacattcccctgactttatttaccacccgagagactcataaataatagttgaggggtcagtgagcgaatgaactagccaaaaaaccagctggggaatgcgtgtgcaggtggagagaatgggcgctgggcctgcctgggcacaggttcacgggcctctggatgcagctcaccccgtgggagcccacagccctgcaggccgggcagcctgagggccaggacagccccacccttctctcaaggtgctggtccagggcctgtttccccatccatgtagcattcttgatctctgggtcctaccacgtcccttggatctcaggctcccagccaggaggggctcccaccaccatctcatgaccttctgaaaccccagcgctgggtgtgcaccttcttgccaggctccatgggcagcaagcacccgcccctggcctgctgggcactgcacccaggaggtgcccagtacttgctgggacagctgtcttctgctatgtcctgggctcgtgtcctgcctgcagcttccgggctggggagcttgggcaaggctcttggcctcccccacccccaccttggtatccctcaacccatccccctggacatggggttggtgcctctattggaggaggtggtaggtcaggcagcctctggcccgcaaagtcggccctgggtccaccagccgcccctctgccctgcctttcccgggtcccgccttccctttctagggctatggctgcttgtggacaagcgtctcacgggtaggaaacgggacctctgagagctcctggcctggctgggtcctcagcatgtgggtctgtgagccaggtccacgccaggcaagggtttttacctctctgagcctcggtttcctcgtctgtaaaaatcagtgaggggatgtctccttgttgcacacacagcaggactgagattagagccacagcctgccccaccccagcccctggtcaggtgggggtgctgccatctcccagcagcctgcccaggcccctccctcacctgttccgagacttcctggccccacatgggcacccggcatccttgtgggctcaccacagcctgatgctgcccacagcccatctgtgtggcctggcagggggccccacagcttggaaatgccggtatctccttgcagaccccaggtcaacactgtagattcctccctcttctgtcatggaccccaggaaggagggtgggtggggccctgggctggtgcaccgccccagaagccctcagctcctggcaggacccccctccccctgcaggccctcccctgggagcagctgcttccctgttcattccaggctgggtggggacccccaggatggccctttctctgctgtctgtgggcctagggtggggtggccctggccaggccctgtatggcctcccaggcttccccttcacccactcgttgtgggcatgtgacacattcattctaactacaaactgacacccactcactgagggcattgaaaaaccggagagccccaggagccaggtcacgtggtgaccccgacagagacaccccacaagggtgtcccagccaggtagagtggccctgggttggggaggcttttaggttggatgcttggttaggcacctgccaggtgaacctcagctgggggcagagaacctggggccaaaatctgggggccgtggtcctggggcgcttccctgggccccactgcaggcacatgccctcccaccacgcgggggagctccccctgcccgtgagccctgcttgcacttcctcacccgtcctcaccctgccccagcctccagcccgccctggagcaggctctgtccctcaggccctcttggccatggggtcagcctggtgcctgctattttgccctcaggacccctttctcctgacccctgccaggagccctcagcattcactgagttttggaggagctccctaaacacagctgtgttcactctggaaggctgagatgtgggggcaggtgcgggtggggtaatgatgttgggtgggctggcagtggagccagagaaggccctcccaggacgagggcgcagggggctggaggggagggcactcgggccctgcttgagattgaactcagttactgagcagccagtctgccaaagtctgatctcccggctttcattctacattaaaaattgatctgagatgggagaagtgaaggcagtggccatgccaccgagaaacactagctgttctctgaggctgctggagacacagcctcctccaggaaggctcccagaggcagctccagaccaccaggcccgcttcctccatgctcatctgccccacgcttgcctcagactcctggcagatcactaacccctctgagcccccagccaggcctggatgggtttgtgtttgcatgaggaggccctggtcctcacaggctccccctgtagccagggcagtccatctcatcctcacccccgtccactctgccggggctcctctgtccctgagttctgcctgaggggctgaaccaccagcctcggggcgggggaagcccactgcacaccacctccctgacatcccgggacatcttgcagagaaggaaactgaggcttaagagaggaaacagtgtctgcacagggcacaaagccacagagccgccttctgcacagctcccacctgcacctgcgtctccaggggagctgggattttccaggagtaggtcctcaactcttgggcatgtggctgggcccttcccgaccctcagaggagagcaggagccacgggacaggagtagacatgaagaagcctccacagggttgggcttgcccagggcagcctgtggccagcgctgggggtcacggccccagtggccttccgagggaatggacaggtctgccccatctctcgccttggctcaggctctgtgtgtgctcactcaatgcagccgccagctgctgctcccccacggggtctcgctcactgcatgcgggctctgctgctgctgtcggtccttggccttgagaattcctctctgggaatgcgtgtttctctctgtgaacatgttttgccttctacaggcctccttagcctcatcagagactcctgaaatgagtttcccggtcctgtgtgggccaggggccacccgcctctccagacccccagggcccatagtggcctgtccttttgtcctgcggcctcgggcccctggggtgtgtgggggggtttcctgtccttcccctgagccctggggcacggggacccctgggtggatgcccctcatcctcatccagtgcgcttgctgccggccccaggccccccgcgaggggccctatggagtcgagacaggagcccacctataggccctgtgtggcctggaaggtggggatgccaggggagctctcctgcaacacccctgacttccagactcccctgagggagggacttccacagggaaattaaccccggacgagcttggttcccaggaactcacttcgagcctccaggaaacaaacagccccagagggcaggacactcggtgtccgaggcacaggagtgagcagggtctcctgggcaccggtgacctccaccagctcatcctttgtccacacctgggtgggctgtccctggcgggctctcagggtagaggcgggggctgggtgggggcagagcaggtgcagaggctggtgaggcctgctgggtgggaggtgggggtgaccgctctctggctgccttgactccattcatcagcctgcagacccccctctccaacccccagtctttgaagccacaataaatattgatttgggcaaatcgatgcatttccgagggcctgggtcgatagcaaagttacaaggatccgggcaaagtcattcacgtgcccaactccagctctgagaagagcctggctagagctaaaaggtgactggccatgtcccgggtgccagtgccaccagctgggctaccccaagggatgggcagtgtggcccctcactctcacctggccacagccaagctggggttgaccgtcagagtccggctgcctgtctctgcgtctccccgtgtctgccccctgcccagctcctggctgcatggctgcctctccccgtcctgtctgggtgtcttcccgcctggatcccagacactcttatggggcgcttggcactgggatctgagcagttctgcacatggtaaccacgggtccagggtagagctgagggccctcatgcgacgcctccctcgggctctcacagtggcccctgcccctagatgggaactcattgcttcctaagctgcctcttccatctccacccgcagcagtgcctcaccctgaccctgggccacagaggggacatctccccaaatgcacacaccagccttggcctgcttaaggtcacctggccatctccccgctctggcctcagcctctgtgtttctgctgtcttctctgactccccgtggggtctgtggagacctgaccactgcggccccacctgggtgctgtttcgcacgtggctccctctgctctgtccaccgtccacagttcagcccttcatccaagccccccaagtgcctgaactgccctctctagagggcaaggctggggcccaggaccctgggaggaggtgcctgtcctctgagtcctcctaagccagaggctgggcagggatgcgctcaagggcggtgggcatctgggctgagccctgcaccctcttttctcctgacatcccttgcctccccccaccccgcctggtctccctccctctctaatcatttctcatggctccaacccactctgcctttcttcctctcctcgaactacaaggctgggtctggtgcactctggtggggccaccttatttatgagaatttgggaaatgcagatgtgatgtttccagctaatagccccaaatcacttgcaccgccccattagcggggaaaccagcctgtgtacattacataccacctaagtgggagccgagacagcggttttatgaccccataaaactttgggagtttattgctattgaacaaacatgtaatccgatgcttcaagttcaatatatatagccagcagcatctagagccaaccatggccgtggctcctacagctgggccaagctgctgagacatctaggggatttggagccgattggcaattgatctgctgtaggacaggggcaggatttatggtggccttgcagggctggtccttctgcatactaaacagtccagaggacagcaaggggagggcagccgcctggagcccagggcaagtggctgcttgtgggttgctggggcagagcctttagcaaaggggtatccaccttgaggacctgcccctgtaaaaacccagcttccttggagactcagctgcggtgggagccatgcagaaagtggccctgtggctgtgtgccctgcccttcaagaggcaccattgcctcctgaagcctgtttccttgtctgcaagatgtcccaggatggtttgttgcccaagaggtggcccagcagagctcctggaaggaaggggcaaacacacaggccagagcagcggtcaaatggctaagccttatccaccagagcccctcacccagctcccattcatccactgtccaccatccattcatctaaacacccatctatctaaccatccatccttctacccattgatcctttcacccatccacctgccactgatttatccatccatccctccacccatatacctatccatccatccatccatccatccatcctttcattcatccatccacctgcccatccacctgctcacccatccattcatgtgtccatccatctatccatccatttactcacctgtccatctctctattcatccactcactcatccatgcatctatccacccatctgctagtccatctgctcatccgtccatccactcatctatccattcatccatccctcccaccattcattcctctatttgtccacctgtccacctaccattcatccacatagccatctctctatgcacccatctgttcatcccccatctactcacccatccattttcacctactcactgtccatccacccacctgtccattcacccacctatctgcccatatacttgtgtgtctgttcactcattcattcaccctccattcatctgcccatatacttgtatgtctgttcactcattcattcaccctccatccatctgcccatctggccttctatcctttccctcaaagctgccccttgtccagggacagggctgtccttatagtcgcagagatgattggagcctgagagagccaaggtgacttatctcaccttgcagaaggtgctggcattattgcttgctcaggacacccgcatcctcttgccctgggcttcacactccaggaatgcctttctcatgtctgtgctgcatatacttattgtaagtaaaggagaacctcatggccgatgatagtttgttcatttcctcccagtcttattgtgtgcacctattctttcttccaagttcacagtctctctgggcttgtatggcgtgcatttcactcaccacagatgtctcttcggggctggtccatggtgttactctcccagcattgacttaaacatttccccactgttggatagtgtagctgtttccacctctttgtggttataaatatgctgtggtcattatctgagctggcagagtgaagtccgcccctctacgtgtttaattagcatagactccaagagggggcattcatgggttaagcatctcatgacttgggacaccccttgtccgatgacaaaaacctggccctgtgatccctgccctcagtggaggagggagggccttccgtggtgcccggccggaggggctgggatgtgttcactgtgagtctggtgggtctcacatgtaggcagagtggggacaaggcagcctgctctgtggcgtgtcccatggcgtccgggttgccttgtctgcagttcactcacattgcccttggtgttgctgcttcagataagttcctgccgtgttaatgctattaattttttgtcatgttagtgtcaaaaatttacccgcctcatttcttgtcttttagcttgatgttttcctttgagccacctgagaatttagcttccacacagtcaaagtgaactcatccttccctttattcttggaaagttccttctcaccagggattcggtaaatatttgcttctgtttacttcctgttcctttcaatggtttaagttattttctgtcagcatcaacttattccccagcccatatccgcaggcctcacactctaattaagaggatgccctatggccgggcgcggtggctcacgcctgtaatcccagcactttaggagcccgaggcaggctgatcacttgaggtcaggagttggagaccagcctggccaacatggtgaaaccccgtctctactaaaaatacaaaaattagccgggcatggtggtgtgtgcctgtgatcccagctactcaggaggctgaggtaggagaattgcttgaacctgggaggtggagattgcagggagccgagatcatgccatcgcactccagcctgggcaacagagtgagactctgtctcaaaaaaaaaaaaaaagtaaaaaataagaggacaccctgtgtccctccctctctccctccctacccttccttccttccttccttccttccttccttccttccttccctcttccctccctccctccctcccttccttcctccctttctgcctaaacttttctcaatagcctcaaggctgcaaataagacctgcccctggcctcagtgacttggtggcacagacgtgcaaagcacagaacgcagaaattcaagtcagggctgaggactgggggtggatgggggcctgctggggggctgggggagagagtggcagggtgagctggggacattggaaaactcttgcagctgtgactgatgatggtgggcaggtgtaaggggtggcttttcgggggaggcacattttggcactgggttatgtgcttcagcaccaggagcaggggtgaggtagcagacggaggggaggaggccatacacctgggcaggggctggatgggactggctgacagctgacctccctcctgtgcccagagagccacagcctgctcggtggcccgcatgggatgaaacctttgtggtcccagcttctgatcactggaggtgagaactagtttttgagagacgggagcaactgctgaagacccaggggctggggcacggcccagcgtttgcttttgagagcttcgccatggcccgtgtggagaggacagcaaccaccagggagggggctgggtgccccagcctgtctgccagcttctgagccccacctgcgtctgcacctactggagacagctgggtgggctctaacctggatggtcctgggtgggaatcccagctctgcctcatgtgagatgagggctgagcctctgctcatcttagaacctcagttttgtcacccatacaatgggatggtcagttagcaaggaaacgcgtgtaggtgccccgtgtagtgccggctgcctgggaggcgctcccagaatgtttcagaggtgattcttctcaaggacttcctgggccccttggtcataaggctctgaattcccagcctctggcctgagtgccacagaccctagagggttcctggccactcctggggtctgtgtggacctcgctgcttaaggccccccgtgtgcactgaagcgcgacaccccgcacgcaggggccatcaggtctttggggattgatagaattaagcccatggaacgtgcatttgcttgctgtgaagccgcaacaatctcgctgccacagggcagaggacgttctgaactgagtgtcccctcggctccctcaccggcctcctgcaccagcagatggtgcctgatgtggtggctggcactggtgccccttgccctctgagcagcggtaccatcaaaacccatcttcccagcagctcaggatcaccgcggtggagtttccagtcgcagatgcccttggcaggggctgtgggactgcaggggagacggaggtctgggccctaccatgtgggggcagcatgcaggaggggcccattcctgccccccggcaatacaagaagcctacgggggtgcccaggggtcagggacctgagagatgtgctcactgagacctagcatgctcacccccagctgccagagggggtagttcccaaagaggggcaggccctcagagtgagctcctgtcctgagatgggcaagggaatattcctgggacactgcagaactgttaccaagccaggcacagatggggccaggcccctcggcctctaagacaaggccggcccatggatggagcacgatggccctgaccttgggcacagacccgacgattgagtgagatggagacacaggcttggcttgtccccaagaagaaagaggcacagaagcagctacagagtttcttgcttccctgtttgggttgctgctggctcaggtaccacagctggcaacagaaacagaggtcaaggcccagagggagggaggggtcgggtctgctttgtccagggctggctggccccaggagggccccgaagctgtggcagaagcaggtaccagatggtcagtgtagcactgtggctagcacccaaaactggacatgggctgggagcagcctgagatgcagggcagaggacagcaagccacgagtctgaatggcccctgttctggaggcagtgctgggaggtggaggctggagggggtgtctcgcagagcctggtctgctgagacataggctgggacaggctgctgggtgtactgtccctgggaagtgcaaggtggcgagtcaggaaggccccaggagcagggttggggcaggagccagtgagcagggcaggaccctcatctggaggggctgggggaggtctccagtctgggatgggggtgttcccggcaccagcccagtgtttctggtgcagcagccacgtcattatggttggaatgtgaccccattagccctggggcggggctgttcaacatcctgaggataattgatcagagggaggaggggctgcaccgcttcctagcaggttgagttaattatcagcctgcattagcacttgacctgtggcatgtgtcaactcattactgctaattgcagggactcagtgacctctccgaacttctgtcacccctgtcacggcccctgccctgtggaggcctgtggaatgggaagtggggaggggaaggagaagggggcggagtcagccggagcctcctggccaggcctggagtcaccctgtcctgccacagctctcatgggtttagagtgggccctggggcagagggtttgcaaggataggggtgggtggctctgccgagggcggtgttctgagtaggtctcattccccagtctgcccagcctggccccaccccagctctgctgccctgttactttgtccccctgtgttcaccctccacttcctgccggggacactccaaggcctgccaaggttggagcaggggtgggactcagccattcaacaaacgcttccttggttatgcagggctgggcattggggtggggggctgacctggaccctccaagacatcagattgtccaactgctcagttttcattggggcaagtgcctcgctgagggtgaagggggctgtgagtgcccatcagggagcctggacaggtcccgcctctcacagctgtcccactctctggagctgccttggtggcagatggcactgtcctagaaaggtgaggctggagctgtctcttccaccaggggtggccaaggacgcttccagggtcttccatgcaggcctccagggtcaccctgggcgtggctgagggcatgcagaccacgctgtgctcccccccaccccccatgcccgtcgcttgcctgacatgctcctcagctgtcttgccccgcagaagctgtgtggtctcccctgtgagtagagtcgggctccatgatcctccggagcagcgccagggactctccccaggcacaattttaaagggggccctaggacctgccaggtccacggaagtggtccttgtaactctctccctggtggcagcctctggtgcattccggcaggggcagcccctcctcatcacagggaccctgtgtgccaggccccagctgcgttgccgctgaattatggatttaatagcagagaagccttgcaggccgcctgtgctggctcgggaaaccggggcccagccggggcctgtcacggtcctggtgccgccctgcttcctgtcggcgccacggagcaagcggagagatttatcttcccggctttaagaggtactaacggaggaggctgagaggcaggagctgaataattgatggccttctctggctcaggatctgctgaaaatgacacggtgcaaggcagaggggctgagagtgctgaccacaaaatgctgagaagccactccagggcggtcacggccagaaggaggacccccactcaggacggggtcacaggcatttggggcgggtgtcagaggctcctgccctgggtcattccagggggccaggatacccagaagctgggcctagaggcccacagggctggctcacccccacttccctctcacacgcctgccatcaccggtgcttcagcccagcaaccccatggctcgttggccccgtccacagcccccactgcctcctgtgtgctgggcgtgggcctctgagctctactctcagcctccttagccccaggagaggagtggaggacaggggtttaacgtggggtgtggtgcggagcggggagggctgtggcgccccctcagcccctcctttcctaacagcctcagcctcccccctggagaatcccctacctgctgggcacatctggcctctccccaccattctgtctccagccgggagatctctacccagtgaaacagtgaaacaggaagggttccctggttaccccgcgcagggcgcagggcatgcagcgggggagtggctcgcttcttcagtgccccaccgctcacacctctaggggagcatacagacgggcaggctgtggggctctgaccccatggcagtgtctgggggtgaatgtttacagctcttgaaaccccagtgggagtgcgttaccgggtggtcttttagtctagcggtctgtaggtggctggtgagagtgagctcaattagacccctgccttataacaaggacagaggaatttctgtatcccagggtttcttgccttggtgtaccaaaaaattggatcacacgtgggcttggagaatgagtgcaaggttttattgagtggaagtagctctcagcagatgggggagccagaggggagatggttttcccctggagtcaggcaacattctcgggatgtccagcagcttgtcttcttccaccagtgtgttcctctccccacacagaggcttctgtctctgccttgctagggtcttgggtttttataggcataggatggaggcatggcaggccagggtggtcttgggaaatgcaacatttgggcaggaaatgcctgtcctcacctaggttcgtgggggtggagccctaggcagggaccacgcccttctctacggagcacttcccgtccctcctctgtatcatttaaagggaccacgcttttcccttctcagcacttcctttccgtatcaacaggaggccagggactggctggacccctaggagccaggtcctacggataggtgagccggccccccagggcaaacacctccactgggcagacctgactgcccagagctggattctttacttgtaaaaggggccatgagtgacacaggctcggcctgctgtgccttgaggaaaggagaggctaaaaattctgccttctctcctaaagccagccgggctctttatggtgggggaaggaaggatttgtttatttgcactcttctgaaataaaagttctctatcctccctcctggctggagttgggagggccccatgggtgggctctgagatgtggcacacggtacccagggcagggctgggaagggtggggtgcaggggcctccctggctgcagggcccacccaccaggtgcctgggcttgctgcactgagcaggcatgggctctggcccccctcactgtcccttccaggcccagcctgtgttcagggcccaggacagggtctggccagcaggccccaggcctccaagatgttctcagcctctggagtgtgtgtgatgatgagcactcatggagcttcctgtatgctgggccctgggcttctgagagggccaccgggtggcgactgagtcacgaggtggagggccagtcccagggactccaggtgacctcgtgtcggcaccacgcccttctcccatgggcagtcctgggcgccccttcctggccttgggcccagtggcctgtggcctgaccccgtccactcctgcttggttgtcccagcagcagcaggagcccatgctggagaaggtgttatggggcaggtggagggcccggctgactcagatgatcccccaagtttcttttcaatgaacacttgtttagtgcagtttttcctcctcaaatccccctcacacaggcagacaccctcttggcccagggtaatctgctgagcctttgctcaaatatagcagctttgctgctttctaaacacaactaatccaatttgggatttggggattcgaggtgggcagcactgggcctcagatgagcccccatcaccccagacccatgcaggaagagccaggcagggtggggccctggggccacctggtgggctcagggccagggcatcgcgatgtccccatccttcacactacggggcttcctggctgcagagttggggactcagctgggaatgctggccatagaggcagagagcccccatcctgctgggccagccctgacctggcttctccagggtggcccagtgtccccttctgcccttcccctggctcccaccgtccacatccctctatctgcccaccctggacaacaaccagcacagtgcagtgtggccctgcagtgacaccacctgcagagaggtcaggcccagcctcccccgtctcctaaaaggccagcaggtcccaggagctgggggtggggcctggctgtggggcctccatgccccaggggccagggcagaccctccttagccggcaaccactgcagattcctcccctggccagcactcggggacctccctgcccctgccccgtccccctaccttgcctgctgagacatagggctccacgggtctctctcctggggccgggctgactgtggcctgcgaggggcagtcatcgtgttgggttttcctgccagaggcagaaaccacaaaattacctggaacatacacgccccaagtgacagattcaattcaattccacaaatattgacctcgcgtctaatccactcgtcctccagtgccagctcattcctgagaagcccagcctggcagccgcagatcccatttaatcccagccccacaatgtcaccagctcgcagcttgggagctgggctcatccaggccctggcaggtggggccagagctgggctctgacctctgtacccacacttaccaccatgtaaagtgctgggaagaggggtggggagtcacggcaagttgagggtccaggcttgccccagctcgccagatgctcgccctggctgccctgacctagcagctaatctctgcggggcactgcggctacatggtgactccagcacggggacatttatcagaaatggaactgatggattaaagtggaaccaagcgaattgatttttctccctgggcactgaaatgctgcgcttaatcaagcgatcaactccgtgggcagggtggctgtggggacggaggtgggggacaaggggatggtggccatggtggggactgaaaggtggctatggggacagatgaggtgagccaggtggccctggggtcgagctccagcccagcctctggcaaagaggccctgtgtgcagaagtccgggtgtgatgccctccccccaccgattgtgtgataccggccagtcctgtcccggctgagcctcggtggccttgatgtaaccctgtggggtctggtggcagggactgattcactcatttgctcattcattcatgtgtttgacacacactgcagcaaaggaaaggtgagagcagccacaggctggccagggacgattcagacttcagagtgtagcgtgcccgcccctcctcttgtgaggtccagccttggtgtgtgtggattcccaggcaccctccaggtccaccctccactctgcagtgccccgcccacctgtccacatactctgttctgtggtttgatcgccatccttctgctctgcggccaactggatggcccaagcggactgagttgggcagggtggtcatacctgtggagcctgtggctgtggttggaggccccgtgggcagctgaggcagcctgggtgggcatgtcccactgggacttaagcccctaggtgggctgtccgaagtgactcctgagtggctggggtgtgctgtccttccagcctggccgtggtggctgggtggtgttggaaggcactgaaggaagggcaggtgaattcgtgctggacctggtctcagtgccatgggccccaggagcccatgacatcactggcctcatggactgtggggattaaccctgtcactggacacccccaacacaccccctccaaaagaaaggtgttggcacaagtgaaaccccttgagtgatggctgggatttcaagctccagactggtccccactaggaagctctgggtctggctggtggagcaatgtgtacccgcgcctctgcgtctccctgcatctggcagccctcccaacagggctcatgtggggtgcagtgaagcagcaaagccccccaccccaccccaccccagactaaacacaggctgtagacctggcccagggtgagaagggcccctgtggaccacctacccaggtggtctgtggcagcctctcccagctttcggtccaggtggcccagggaggtggcagccctgacccttcctggcgataccctgattgatcatagtgaaacactgagctgggagagccaggggcacccagggctgagctcccggggcagctcccaggagctgcaagtggacctggcactaggaaggagcagtccaccgagcacctaggccagggcccgggacggtgccaggcaccagctgaggccctgccaggccagccgcatcttcacattcaagaccccaggccccagccacggctctgagctctgggtgtctgcagccacggttggcagggtgggccccaccttgccctgactgggccacggactggtgtgaagagctctaaatttcacttactcccccaaagtagaagtggcctaggactgtgtggtggctcctggtctccagaaccctgccaggctccagggcaagcagggaagtcaggcttagctgcagggcagcacctgtctgcacaccccgtcctgccacgctccctgcagggacctccgcctgttgtccatggtccagcttgctggatggggcagcagctcctacactcagagctctgccatccccagccccaggccaggctctccccacagcccgttaggccctgacgtcccctgacaaccaggagttggacaggcctggcccccaggctgccccacactgccatgaggaccccagctggctgagtcccatgtccaggctcacttcctctgtccctgcagcagtgagcacctgggaccatcatggtgagcaccacccaccttgccccttggcccatactcggggacctgggttccccaggtgatcagggtggcctgcagggcctgaggtggccatgccagccaaactccccctgccccacaactgggtcacctcttcaccctcccgcagcccttgggaacccagtgagctcctcccccttgctgctttgtgagtgctggcagtcctgggttgctgtcctggagctccaagacctcccttctggaaggctggggcttcctggtggaagatcccgctcacctcagctgtggcgtgggcctgggcttcagcctggggcagccctcatgggcaactgcttcagactggaccccatgtgctggggtggccagggctgtgcatggcaggttcagggcacagggtgcaggcaagggtgtgagggtgtgggagggcttcagtgggaggccctgatgctgagcagacacagtacagcctggtaaacaaggctcgtgtgctgggcactcatcgatcttggccattcgggcctggccaacagccggtgggctcaggcctgggcgggggctggggtgggagtgagctgcctcaggctgggccgtgggcactgcaggtggcttgtccggacagccctttccctggacccctcatgcccatggctctagctgaaaacacagctgctcttctctacaggctcgtcctggggtgaggagggtgtgggagctgcctagcccttcctttcccaaggggttgggtgcccctggctgaggaggagaccctcatggctggaacttggtggtggtcagagcctcctggaagttgaccagctgagctccagcaagtccatgcctcctgggacacagcctggccccgatgaaccctcagctgccatcatcctcaaagtcgcagcaggctggatgctgaaggcacagggggccgcatggactgtggctgcagctctctcattgtcatggggagggaatggcctgcagccccatcttgttcccttctcttaacagcctctttccaaagatggcccgagctcccatccccgcccccacagggctcttcctgcacttccccaggcatcctgggaggagaggtgggctgtggctggaatgtgccgccctctcaccctcctgccaggaccactgtgctggctgccttggtggcctggaggcctgcagagctgcccaagcgggggctccatgcgcagctcccactccatgttctgtccctggggaggcccacacagcactgcccctctgtctcattccaggtgcctggtccccagcgatccgccttgaccccagatgctcagacttgctagcccagggccagaggggcacaggacagggctttggagagggggcttcctaggctggtgctggcccagcctgcccagccctgccctgctcggcccctgcctgtctgggtgctggacctggcctgatccatgaagcttctcctagcgaggtgttttccaggcctttggaatcttagggatgatttcgtatggggaggggccttctccccagcctgctgtcttatttttgtgccgattccccgcagcccgagctcctgcccccagcacctgcctttccagcctgtgtcctgtcttccaccagcggactccagcctggctcccactgccacgtggctgcctggcgcatgctccaccccgtgtcctcccagggtcccagtgagggcccagccccgcagtgcgcagtctccgcagccatcgagtaggcggccagctgagcagaggtgctggccggctgccagcccagcacccgtcctgctgaagttgctcctggcacgcttccggccccaggcttccctgggtggtggggcagactttgtgttgctggtgtgcaggaagggcccacgacccccacccaacatgtgagaggggcatttggcagccatgggcaggacaccaccttcgaccatcagctaggggtatgtgcaaagggcctgagtgagaaacaaaagacaaaatggaccaaatgtgcttgtgtggccgggtgtgtgaattgtgtgcaggtgagtgtggaaagatgtgtgagcacaagcctgtcagcatacacgtgtgggcgtgggcatgtgggtgagcatgcaagtgtgtatacataagtgagtgagcacgtgtgtgtggacgtgcatgttatgtggatgtgcatgtgtgcatatgagtgtgtgagtgcatgtttgatgagcatgtatgtgtgggcacacgtgtgtgtgtcagcgtgtgctgactgccatggacgtgcacctggctgagtgtggaaatgtgtgtgtgagtgtactggcagtccaggttttacacccacacggctttgcctccccaggaatccgttttaatagcagagtgggctggaagggctggccaggccctgaggcagttttcaggccagcagtccctggctcctcatatgcggtgacagcccaggaggccggggccctcagagtgcagtctttggacatgcctggttgatggatccgtcattaccagcctgggagctgggcatgggctccggggctggaggacacccctttccatccctggccctggcgagcccggccctcctctcgccccgtgataacctgcagcctcatggggaaaggcacgcggaggtggtgccgcacccccagccctcacccctgctttgccaatcctggatcctggcctccgcccgccaaagtccaccattggccacaggatgtgggtgctgtgctgtgtccttgaaaatctgaagatgaggacagctcagtgggcgggggcgtttcacacattcgacacatgccctcacgcctgtgggtgtgtggcgggctggtttacagttacgtgaggatttcagacccaaagtgcagagcctgcagctgagcagtgcccagggagggctggggaggaaggtcccagccaggaaagtagggtgactctcatcagtggctgcggtgtccagctgggatgatcagggccgtgccagcctggtgcgcctgggggacccacagcagaggtcctgcatgcacttggctggcacgtgtagttctgaaggcccctggggaggcctggcacatgcagtgtttggggaccctctctgctgcctagacactgccacagaccccacacccaaccttgctgtttttcccccaagtgaggggagctgctttttccaactcggatagcccccctgcactgtgcagctcgcccacctccctcacagctattccagcatctctgggcgggtgcgggaagccggatgcagccagtaccgttgctgtttttggaaaagagaggttcaaggcagggagggcccagcctatgttccagcagggttgtctggctgggggggtctgcacctcgcccctgcacccccaggttcctggctccccacccccgtgcacgaagcccttcttgcctggcaggcctgggggcccccggccgccatgcgccccaccgcgggtgtgatttggcagcagcgttctcctcgccagcttgtttctcacataggggatgtttccatttttacagcagaaagaaaccgattccaagcgcctcagccacagccggagcgcgacggcccccagggagctgctgccacgtcaggtgctttgggggtgtgggctgctctgccagccgtggtcctaattgctgtcactcagggagccagctctagcctggggcaggcaggaaccatgaggggggtcttcggggcaggcactggtccctggcggaatccgaacctctgcctggttctcctggcaccccctccccagagacctggagcacctcccgactttgggtgggatgggcctgtggttctggaacaggagctttgcctgtgggaccctcccatgggggcggggtgtcctctcttagcccaggtgggtttgagccccacactgctccttccaccgctcagattcccgcctgcaggtccctgtcacggggctgctgaggaccgaccaaggtgactgcccatagccccacgccagcatggggcacagctgcctggcggctctgccgtcaccccccgtgctctgactctgtgctgtggatttgtgtcacctgcagacttgggtggcattgggcacaggggcacggtgtcctctgtcacttccccaccttgcttggggctggtctcccaggatgctgaagcattgaagtgcctcgaggactgttagaaagattttcttagaaagaaacatttgctacccagggcacagaacagctcctcgaggtctcgtaaaccagtgtggactcggccctgctcccgagacttggaggaaaggcagaaagggcggcaagtcacacgcaaggcaattttcaaagaaaagggcacaactcataggaggcaggggaaggattccatttcacctacagtcatggccccgcgtcttcagggaataggtgctgtctggtgcatcacattattagtgctggagggcatcgcagtcctgggggaggtcactgccagcatggcagcccataggaagtgggagggtgggattcaagggcaaggcgggtggtgggtcctggcccctgatgaggcaggtggatggtggacctgcctccaccctacccagcaggctggccaccagggcgtgtccacagactccagacaagaaggagagagtaaattgaggcatgtggggcccaggccctgggcgcaaggctggaggcctgaagtggcatcccatcagctggaatcaggattgcctcgatctttgattcttgagacaggaggagtgtggcggtggccccagcaggatccctgagatcttacacaggtgaggtggttgcagaagcactacacggggctggggcctgagggtgcagtgctgggtctaggtctccctgagagtccactgacagctgtggaaccaggcctcaggggagctgggtgcaaatcccacccctccacagagcagccgtgtgacccgaggctgttttgccctctctgcctcagtttctctctggcagccgctcctccctgggccccgacctgacccttcaggctcaggaggctgctccaggtccagaacctggtgctgcactgggtccagcctccaggcctttgctaatgttgtggtctctgcctgtgataactcctgcgagagctcctgatctcttatgaccctcccctgcctgggcagatgctcctcctgtcaccgagggtcccattagctggcagctaccctgccacttggtggacccaggtgatgtgggtgggcctcactcttcatccacaagtgggtgagaaaaggcaggaaaggaggtgaagccaaagatggcatgctccccctgcacagggtgactgtatgggggggtcacggcgggggagggaggggaggagagtggtccatctaagggccctgccagggcccaatgcaatgtcccatccttagatccatcttcagtcacatccccacgctagggggagcagcatttccaaaacgcctgccctgggggctctcagaattcaggggttccctttgaggtcacacaggccccactgaggccagacacagcaagtccttgctccttggcctaagcctgcaacccctgagcctcagtttcctgcagtaagtgggacatgatgcctttccactcctctaggcttctgcccatcctgtgtcaccgtcccagcagatgagtagctggtctggtggcctgagaccttgcttcactgggggacagggctgccatcctcgaaggccagggtctgggcctctgggccgggagctcctccatcagcttgcagccctgggggaggcttgcagccctggaggccactccctctagtgacagaacccatacctctgggaactgcttcctctgcctgcatgccccaaacttggacttggaggttgtagatggccgtggcagggcccttgcctggcccctatcctcctgcagcctggcctaggcatgggtgacttacccagtgccagcaggctgcctcagcccgtgcccactaaaaaatttgttcctggccgggcgcagtggctcacgcctgtgatcccagcactttgggaggctgaggcaggtggatcgtctgaggtcaggtgtttgagaccagcctaaccaacatggtgaaaccccgtctctactaaaaatacaaaaattagccgggcgtgatggcaggcgcctgtaatcccagctactcaggaagcttaggcaagagaatcacttgaacctgggaggcggaggttgcagtgagcggagattgcgccgctgcactccatcctggacaatagagcaagactccgtctcaaaaaaaaaaaaattgttcccatgatattccaaatacagtcatataccataatgacatttcagtcaaccatgggccgtgtatatagcggtggttccataagatgagaatactgtatttttactataccttttctatgtttagatacacaataccactgtgttacgatcccctacagtgtccaatagagtaacacgctgcacaggtgtgtagcctaggagcaaaaggccaaaccaaatagcccaggtgtgtagtgggctctgccatctatgcttgcttaagttactctatgatgtttgcacaatgacgaaatcaccaaacaatgcatttctcagaacatagccccatcatgtaatggcatgagaggacacgggcagaattcttggatgcccattttggggacagccaccatagtttggacattaatacatttgggcacatgcacatgagcacacacatgctcacatgcacatggatgcacacgtatgcgcgtaccactcactcccgggcacatgctcattcccgggcacatacacagtggggcggggcaggaaggctggatggggcccaggggagtcaggtgctgtggtgcgctggggctcaggcccttccagcattcaaacagagagtctcctaagaaagcagggagcccacagggcatgggatttggaatctgagtcagggatttgaatcccatcttgtgccctgggcatgctaagtctccctcctagtgcagtgggtgcctgctgcccaggctgcaggagcgtttgaggaggcttgtcagcctatagggaactgcctggcgtcctgctcagtgctgcaggctgcatgaggggccaattgaggaccccctaagcccaggaggggcagaggccagggaccagatgccacaagtatctgtgggtgggcttggctgtgatgagcaggacagggctcagccaatgcccaggggcagagcccccgaggcactgatgaccacagtgaggccagcgtcaggctctgggtcttgggtcttggtgctgctccaggagtggacccacatggcccctcagatgctgctctgtgactccaggcctgggtcaagccgacctctctgcttgtccccccacctccctctaggtaactaggccccaagatgtcacagcatcagaaatacagagaaaaaaaagcatagttaatactgctcctgctgggaaggcccacagcagggcggatggtagtgcacccagcaggtgtgacagcccagtctccccatctgcagggaaaccccatgccccctcaacccttactgcctgtcaccagctggaccccggtctctcctggctgctgtctcacctgccttcacatggtttctggttctttcatcttttcattataatttttgtttggagaaactttaaaagtaaaagaatgtgggccaaaaatatgttaacccattcccaccagacatgcaacactgggggggctgttcctcccaggctccttgggccccccagctgcccatgacccctgggtgtgcccagacagcagggggggtgtagtccacccccaccacgtccacagcccctgactctcgggtgggtctgggggctgctcgccctgggagagaagccatcccctcccggcggggccatctatcaggacctctctgacatcagcattttcctctgtggctctagcttcctgcctcctatctctgtcctcctgagaatgtcccatctgtcccatctttcccattagcagccctgtccttgagcccagtgcaagctccacagtggagaggccactcagcattgtaagtgaatgcttgtcctcgtgcctccctccccgggagctctgcctggagctccttcccggctccggtgaagctgcaggcagcatttcattgctttgacctgtcccagggcaccttccttctagaagggcgacttgaaaccttttcatcacagcacgacatatgcccggtcttgctttggtcatccagttttatgtgtcccattttatactcattttcttcccctcatgttttgtttttttcttttaactaaaacgatccatttattgagttaaaagattgtatattcaagacgttcactcagtatgtgatcctgcatagtaaacctcgggtgaaacaaagacaactatttttatatatttttaaaaatttagtggcatatagacttctaatattttggggggggggatattctttttttctttaattatggtaaaatatccataatataaaactgaccactcgaatcatttctaagtgagcagttcagtggcatttggcatacttacattgttgtgcagccatcacccccatccatccacagaactttttcatcttcccaaactgaaactctgtatccattaaataacaaatccccacccttccccgcccctggcaaccactgtctactttctgtctccatggatttgactacagtgtgtctaagtgggatcattcagcatttgtccttttgtgactggcctatttcacccctctgttttatacctttctgctgcgtggcgctttggctttctatgttctgcggcggtgggtggtaaagtggatgtcctgcttttaattctgagggctcgcttctcagttttcaaaaacacactttaatctctgattctccaattatcaagcatttgccatgaaatgatacttgctgctccccagcactgcagactgtgtaagagacatctcagccagcatttggattaagtcaaaccccaggaatccgcacctcctccacctcatcacccaataaaaaaggtaacgctgaggtattagaacattcacattagttccatgagcatgccctcttatgggcctgagagcacccaggctctggtgcaagccccccacagcccagggaagtgtttcaggactggagccctgctcagtgctgtgggctgcacaaggggtcaactgaggacccctaagcccaggagtggcagaggctggggaccatcccatgggctcccaggatggccttggggccacagggattatggccaggcttgtacttccaaagcccttccagggaggaaggcgctccacttcctgctttggcttaaaaaagtccagggaagcacctgattggcctggctcaggtcacatgacactccctctgtccaatcactgtggccaagagaatgcgctattgtgattggcccagcctgggtcagagccttcccctgctgcctggagcagggtctgtctccaggagagaggagtagggttcagccattccaatggcgctgccgcctgaagagctgtcagtcctactttgcagttgagctggctctgagaagaaagtgctctgcctagccctgtgattgatccacaacttcatggggactcaaacatgggttcttttattccaggtggagaaattgaggccccaagcaggggcagactcactggggtcacatggtgagttggtggcatgaatgggtgctccggtctacactgtaccacctcctccaggaagccttcctggcttggtcaagccaggcctggggtggtcaccacctgatgtcacatccccttgagacaaagccccccccctcccccgccaccaggcacctatccccagtgtccaggacatagctactggattcaggcagcttctgcagatgagctcccagccctatgtccaggaggtttctggaatcgacagctctccatgccacaataccctccatggctatttagggaacacccagtgtgtgccaggttcggctggcctgggagagtgcacagtggacactggtcaccaggagacacagggggccagtccacacccttccgcagtcgggcctggggaatgggttgggtactgacctggaggagggagggacagcaggaagggctggctgggcctcagctctcttgcttaccttccattctctcgatggccctggctagacacatgctggctcgcccaggccctactcatgtttcggcacaacgaccctgctctgcctccgtccccaagaccctgggctgtgcaaccagggccagacctgttcttcagccgcaccagggcctggctgtgcctctgcctgtcagtggccaagccctgagcctggagccatccagagccgcacggaacccacagcctgcagggtggggctagacatggctcctcctgcccgcccgtgggtcgtacaccagctcattagagccaaagcagcatcgattttgtgaatgatgagcatgtgtacgtgtttttggagccctggtgtgatttggcgtgtgcagctgatgattcaggggggtcatgtgcaaacgacacgccttataaatgtgaacccaccagaacgccccgttacggagatttacactgatccttaaacatcgtagattaatttttggaaaacatctataaaataagagatttatacctaaaacaataccctatgctgtgacaggaagggattagagtcaatttattcctgtattagtcaaaaactcaatttcatatattgtgtggaaaaattaaaaccctttctacattttattacaaattatgcatactccatatatggagataaataattgatagcattacaaatacttaatctagaaaatatttattaggaacagacaactcatttttcatgtgttttgttgagaacaatattgcacactttaaaaaattaatgatgactctttgcaaaaataaatgtctacatcctaattcttttgtttagcattgtgtccaagccaggcagacgcagccgggcagtgggcaggtggccatggagctgggatgtccactccctggcccctggctgtggatgggtcagagggctcatgtgctgtggcagttggccagggaaggtgcatttggagagtgtcaacatactgtttgtcttctgctgtgcaaactctcctcgacttgtaatttaaaactaaaagtgtttccgacttaatttctgagaaagcaccaagtaatgggatttgtggatggacttgaagagccaagaaatcaacactgactgcctctcgacctggagaattacggagcccatgaattctctgggcctcagctctggtcccaggctctgtgcacaaagagaggtgggcctggtgggtggtgcggagcttggccttgtacttcgtggctggctcagcctgccctcctgggacaagtggctctgccgggttctgtgtgcctcctggcatctctctgaggggagctcccagcctctgcctagaatacctgggcagcgtgttcagacctggggccccctgcaccatcaccccattccaggctgggaagcttgaggacccaggcagggaagcttgaggacccaggcagggccccagtgtgccacagggcttggccactgtgcaactgcactgcagctctggcctctggccgggccttgcttaccgacctctgccctctgccgtgtgtcctccaccttggccatgcacagcgggggctaggcgggcacatggtggaggctgccaatggtgccctggcaagttctcttcgccctcgtgccagccactccagggagcaccagggattgaataaataactgccacgtttattaaaaaataaatttggtgcctaacggaagtgctgtttctatacatagaaaaaaatgtttaaaataaaaaccaaaacagttctcaaaggcgctgtggcattaattattcatcgcttgctaatgaaaacatggctttgcaggcgtggcccccacctccctccaaataagactcgggctcagggaaagcctggccttaagggcagggagctggtgacccctgaataaaatgggggtggctgtgatatcctccatgggtatttagggagcacccagtgtgtgccaggctcggctggcctgggggagtgcacagtgggcactggtcaccaggcaggcacagggggcagtctgcacccctccttagtcagcctggggaatggcttggggtctgacctggaggagggagggagcagcaggaggggctggctgggcagcagagccacctcttggaggaaagaaatggggacagaggccactctggccagcaccagaggacagtggctacatgtctgggcacccaggccaggggcctggcaaacccccacagggtgggtgggtgaggccctgttctaagtcatttgatgacccagccaccctctcagatgctgctggatcccagacagagggagagagggaggctgcaggccttgccggaacctaggcgtgccatgcatgccccagcagccagaaccagccatgtggtggtgccacaccagaaagggccggcctgccaggcagtcaggggcagatgggagcaacttgggaaacagcagcaggagcctccactccctctgcctccacctctccagcagactatatggcacaccctgcccagctgtgtgcagcagggaaatttgtgccaggcctcgggcacctgagcccacactgggcatcgctgtcctgtcactgatcctgggcactgataggaactgtgaacaaagctcggtccagggccctgtggactgagctccccatcctcagggcccgggagcccctcctcctgcagtcacctggggcagccctatctctgtggggaggcctggagcatttgttcttttgttcattcattcgtttatttatccataaatgcccccgagctggctgcctggtctcctggggagaagggatgctgatcccatcagtcacctgcctgagcagggggtctgggaggctgagaggaagcctctctgagctgctgtgggtgcaggtggtatccagggcgacagctcctgggcaggagatgagctgtgccctgaggtggtcaagtggaaccccagcaggggcctttgaagctccgccagcccctggggcaggtcagggatggggaagaggctgcagggggcggcaggagagtgaggctccatctctgctgggtggctccgtcctggttagcaaggtctctcgcgtcctggcccctgtgctggctcctgggacgtggagtggaacccgcatccctgctgcccatgtgtgaggacccgggctgccagggctccagctgggccccaggctcagggtttgtgtgctggagacccagcaaagctggacagagcctggcgggacctggctctgcgatggcccagcttggtgtactcagaaggcctgatgggagctagcctggacaccttggcctgatttaagcctgggagccgcgtaaggggaggcagttgggcctgccgccgaaccgacgccccgctgcccccacttgcctctcccgccggtgggcctgaccttgctggaagcatccctcagcctggtatggatttcctgtcttcaccgaggccgcagggccagccgggcgcaggagccgagcggtggtcaggcccggggatggttttttgtttgtgggggcaggggctgaggggacccaaaccttccagagctggggggttttcttctcacctgtcactccgtggctccctttggtggctctttgtctggcatgggtgctgggcccaccctgcggtgtgggcagctgtccagcctagagcctgcctctgaccctggtcctatcctcagggccccttccagggctggagcaacagggacacaattgctgagctcagcctgtgtcaggtgcacaagtgacctcacttgggagacagtgcaactgcagtgggcctagagagggctcttcagctcccagtcacacagccaggcctggagaggtacacatcctggtccctgattcccccatcggcactgggtggactgaggagtggagtggggaccctgggtgggggagaggaaggaactgggcacagggggagagccagggaccagagggcatcatggagatgaaaggacaggcgagcccaggagggcacacaccatggcacggcaggcagacagacatagacataatgcccatatggcagcatgatctctcacacacacacatgctcacatgggcagcacactcacacacacgtgcatatggacggcacgctcacatacacacgcacacatgggcagcacgctcacacacacacgcacacataggcagcacacacacacgcacacatggacagcaggctctcacacacgcacacatgggcagcatgctcacacacacacatgcacacatgggcagcatgctctcagatacatgcacacatgaacatgggcagcacacacgtacacataagcagcatgctcacacatgcacacatgggcagcacgctcacacacttgcacacatgggcagcacacacacacgcgagcaacacgctcacacacacaacatgggcagcacacacatgtacacataagcagcacacacaatgcacacatgggcagcacacacatgcacacatgggcagcacacacatgcacacatggacagcacactcacacgtgtacacatgggcagcacgctcacacacatgcacacatgggcagcatgctcacacatgcacagatgggcagcacacacacacatgcacacatggacatcacacacggacatcacacacatgcacacgtggacagcatgctcatacatgcacagatgagcggcacgctcacacactatgagcaacaagctcacacacatgcacacatgagcaacagacacgcacacaggcacaacatgggcagcacacacacatgcatatgagcagcatgcgcacacatatgcacacatgagcagcacgctcacacatgtaaacaggcagcacacacacaagcacacaagagcaacacacacacatgcacaacatgggcagcacacacatgcacacaagcagcatgctcacacatatgaacacatgggcagcacgctgacacacacatgcacacgtgagcagcatgctcacacacgcacacgtgagcagcatgctcacacatatgcacacatgggcagcatgctcacacacacgcacataggagcagcacgttcatacacacatgcatacatgagcagcacactcacatgcacatgtgtgcacatggacagcacacagatacacatgcacatgtgggccacacatacacacacatgcacacatttatgcacatgggaagtatactcacacacatgcatgcacacatgggcagcacattcacatgtgtacatatgtgcatacctaggcagtatgctcacacacacacacactcatgtgggcagcacacacacgcacacctggacagcatatttacacatgcatgtgcagcacacatacacgaggcagcatgctcacagacacacgtgcacacacacaagcacactcagaacaagctgtggggcctgcggtgaggacaccaggcaggcaaggcggctgctgcagaaataattagtcactggtagacaggcctggctcaccttctccaaagccaaaggggggctaccagcccccagctctgggaaagggctctgagggcccgcccccaccttgcagtggttcctgggacctgcagggagcatcccaagcacggcccgtggggtgcgggactctgccatgtgatccctgaggctgggcctggccggacgtgccttggcccctgcaaaccgtgcacatccccaggtcccccagcacagcagcagtgcagggagtggagacgtgaagatggggagtggagacgtgaagatggggaagaaggaggttggaggtgcagggccgccctgtgttcttgttggagtgggggtaggagcactccaggtctggttgggccctgtgagggtgttggggaccccaggccaggcctgggtcggatccatcactccctggaggaggcatctgagtccagggatgccggacaggctggtcccaggtccccaggctgactgggcctcaggcatatgggcatctgcagctgtctggggccaggcccaggctgaggggcagccagcagggtgcaggaactcccaggccctcagcttgcagcgcagagaagggtgactgctctgctgttaaaacaatttattttgctcttcaaaaagctaacagctgtttacagtcagcatgtgggagctgccccctgggtgatggattctgccaatccagccctcccttgccttccggcgaggaggggtcatcccaggcttcgggtcaggatgggcagagcagaccactgggggccaggccatgatgttcctggccactccacgtcccctcggctgccgtcctgtgtgctgccctgggagagtgcaaggaagggtggccccctgaggctgatacgaaatggtacggtgatgtgagggggtcaggagggaggaccactgtgggaggcgtgaggtgcagtggaaaggtcagggagaccttctgagaaggccagcagggagggctgcccagggcctggagagcgtgcatagctgggggcagggtgggggcagccggcaagggcaaagcccagtgggtgtggcgatgccctgggggatgggccccgatgcccctaaactggttcggctctctagaccagactagtgtgctatgtcggagccgagcaacagtccccctcaactgtatgcatgtacagtaggcgctcaacagacacttgctggatttgacaatagccctggacggaggactgaggcctgggctgcacacattctgggctcctgcaagcccctggcagccctgagctggtttctgagtgcagagggaggggctgtcaagggtggaacccacacatgccaaagcctggaggccagtgcaggggcagggcacctgctgcctcgggacagcgctgaggttcaaagccacctgctggttcccacctgcctggcacaggaccctgtgtcggtgggggtggccagatagggcagctccttgtctccctggaacctgtaccctcagaggtccaggatccctgggggaggttccggggctggagagacggcccctgtggcagggcagggacagacgggctgattctatctaggatgggggcacacaaagacttcctgaggggcgcttcaaggccacagcaatctaggtgggacagggacatcagtcagaggtgccctgtggagacccccaggtccagctcctggtactgtgagaagccagttgttccctcgcaggccgccaaggcaccgcacagtcctggcctgagtcgttgtggggtcttggggaggagggttctctggaaggacactgagcctggactttggggcaagagacccagagcccctggatgcttgcggcctcaaggcccaacatgcagccaagcaaaagctgggggcacaggcaggggatcccctctggggaggatgcagaagccgagccaggctgggccgaagctccttacctgatctggtgtcctcctgtgcgatggtacaagagcctcagggcacatctggtctctgtgacaccccccgagacacccggggaatgttcccaatgaccactgttgggccactgcccgaccacgtcacggttgcccctgccaggactcaggcaaaacccagctgtccctggcgctgtctcccaacagccctgcagggcccagtgctggaccagggccttgtctccagcctctcccccatgggactctggggcctttgggggcccttgggggccttcctgcaccctcacacctactcatctctggactcagcctcagtgtgaatgctcacctcgggctgagccaacccctccagacacgttctgcagctcgaggaaggaactgccctttgcagctgggatctgcccgagtttcagcagcagccttgaattgtaatcccgagcggctggcgaataacacagcacacagcactcgagagcccaggtgagtcctaagtggggctgggctatgggatctctggcttctgggcctttctcagaacagaccctccaggccactctcccctacatccccggttgctgcactgggtgcaggggtccagagccaggtcagctgctgcccagggagagggccaagactgcagaccccgccaagcctgggggcagccttcctgacaacagcaccatttgctgcttgggatcagccaggccggctccccgcagatgggagggctgtgaggtgagcaccagcgagcccctggaggtgccagaaaatgccagtgtgggcaccagggggcttccttgggctggcatgtcaggggaagcccactggggcggctcagtgcccatgatggaagctcaagtcccacggtgctgccccaggagctataccccagtgagggtcgttggctggcgatgtgtctggctggcatgggctgcctggtaacgaggggggcccatgtgtgaggagccttaggtaaggatccagctggcacaccgaagaccccaggccaggggacacaggctgggggagggggctacagagacatgaacccaaaagagaatgtctgctgacatcccaaccctgacagataaccagctgggtgacaggtgggggctgtgctcagatcaccctcctctgtcctgtgcacatgtgtgggtgcatgggagtccatgcgttgctcctggcttgccccctcctctcctcggcccagcttgtggtgctgcgctgtgcatggagctcggtttcttagcaagttcatgccatgagccgccagctaggctgaggaggagtgggtctgggtgccactggggcggtctgggcttccctcagctccagggctcttgcccttgctagcattgctgtgattctcaccattgcgccctgttacagaagagacaactgaggcatggggaggtgatgggacccccagggccacccgcaggaggtggccagcccagcagccctgcccagtcccccgccggccttgtgctcccatctgggcccctatctgtagtttccccagttaacaaaatcacaacagtcattcctggttgttcttgctgaattctctccatttgaggagcagcattttggggtctgtgtcctaaatggacccaatcacaggagtcacccagggcactggctcagcccaagacaacaccttcccccatgtggacacacacacatgggggaaagaaaaccttgccaacccgccctctagcaaaggggcctggactcgcatttttaacaagaaccaagagatcccgtggaggaggtagtccacagggggaaaaacacccttgagtctcaagtcccccgtggctccccagctctgccagtggctgcatggcgggtgagatgatggtggctcttgggtccctctgagtcttgctgcccaggctggcaccggcacattttgtcttggctccatgctgtcgggccctgagctgggcactgggctccctgagtctcgtgggagctgtctgggtcctgaagcaagtggtggcccgagcaggggaggcggtccccaccctcggggacactgtctgctccggctgtgggctccgggggctgagagctatttcggctgcactggcctctccactcctgccaggcttcagtgagctaagattgtgccaaagtcaacagaacagaaaagagaggctatggcgctctgtcagggagaaagcccaattaggaggggcttgtgggggcagggcgggagtgcagagggagccccggaacctagccagcccactgtgatgacagggccttcgacagcagcccagcacttggactgtgcagaactgcggagatggtgctgtgagcctggggagggtgcctttctccccaggggcccgcatggggccaagtctaccagacttctgagccggcatgtctgggtacaggacctggccctgcagaactagcctgggcatcagagcccaccagaggtgactgccagcggccaggacccaccacggagtctcagggagcagcacacgggtggggagcgggtggagggcacacaacgctggtggggcatgggcctgggcacctctccagctggacactgcacatgacaccccaggccaggccagggtcccctgactcacagaccccaggcacagggacatgctgttttccttttagtccaagtgtacggggtgaggagctgcagcccccaccctgagggcctgctctgtttagagggggtgccagggtcctgggtccctccctctgttagagctgtctggaaatcctgagtcgggtaggtgaggtaggaaagggagacctccccacccactgccctgcctgagcggctcccacggtctaaaccctgtcttgggggtggttcccaggaggaggcagcagagcctggtgaaaagagaccagacagtgtggacctccctggccctgggatcaacagcctctcctgggcccagcttccccaggcctgagcttggggttggaggatcggcaggagagtgagtccatgaaggcaccatccccacccctcagcaccctttccctccatgtcatctcggccacccatctcagagcccagctcagcacccgggccctactgggccaccccgtcaggccctgagtccccatggagggtttggaggctggaggccggtcagctggggaggggaagggcagaggagcaggggtgagccacttggctcagggctgaggacctctcgcactctggccactgcagagggtgtccggctggggcaggagggctgtgggagagagatcacatcgtgtgtgggaggggacagtcccctcctgcccagtcccctcctgcccagtcccctccccacaaggccttagggaagggtgggggtgccacacaccatgggctggtgcccccatcctggctttgcctacctaaggctctgggattggcaggcatggagttccccagccctgagcgtggcaggggcaggatgacagacccacggtcccctaagccctccctcctccacttacaccctcgcccgccagaccccagtcattctcctgccctcagggcctggattcagccccacccccagcctccttgtaagcccggccttattagtgctgcttcaccccgactttgcaagtcaaattccgcattactgcgctcctgctctgtttccaccttgatgcatggagagctggagagcagctggagcagagaaggcactgcaatgaggcggcaacccgtgctggccaggggccccagggcccagagccaggtggggtggaccccgaggccctgtctttccacaggtgtccagggtcactcccaccccacccttggcctcctgctggctcagccccacacccccaccaaagggccaggctccgggtgagtgatcctcagggcccccgcacaggctgttccctctgcacacaggctatccctgccttcctgtccagccagtgggtggggagaagcgagtccctcctttcagggattctcaggaaccgagtggctatcagggtatgcagctgtgatgcacgtggcaggagaagacctcagacgccacagcctagctctctgtggggcaagtgtgtctcagcctctctctgaggagaggagagcccctggactggagggtgccctgctcagctctgcctgggtattctgtggcttgcagggtggaaggtgaagggctgcaggcgctggccttcccaggccccccactgtctgcccagcttttccttctttggcagccccagttccttccttatacccagtgggacagcagggcccagccctaggggccgcaggagacagacatgccccaactgagacagacaatggccagcatggcaggtggcccagtctcggccaccaggacgtcctaggaggtacggcccctcagctaagctggctgtccttagtggcccagctctggctctggctggtcctgtgaactcaagatggcagacactgttcctggtctcaggccaggtcttgggtgaagaacgttgggtgtaggaccctgtacctctcctcctggaacacccccagtggatggcgaggtcactgaggctccatccaacgggcagcctccagggcagccctcgctcctcccttgccctggaggtgggcacgggtcagtggaaggatgggactgaggggctgggcccttcaccgaccctggaaggtggctccctgtggccttccctgcagtttcctggtccagtgtggttcagcctaagacacaggtgaaggcctggttatcacttggctgcttttgccaaaagagtggcttccagtgaaatcctttggctgccgaaaggcaaagtcaccctccctccctgtggccccaacacctgcagggtttgtcagcagaaggttttcacggtccactgggcattcgcgggcctttggcatcctcgagggcctgcctttgattagcacacaccctttgcttgacccagagggtccagatggcactggctccacggcatggccttgagaattgaggccggcttcggcgaggatggtcccacctactctggccttcaggccttcaccaggagagattcaggctgctggcccagccagtctctgcagggacaccccggtgggcccagggagggactggggtcagctggggccctggacttacagtggatcccacttcccccacgtcttgcttggttctgggcataagggtcctagttcttagggcctggcctggccctctcactgctcccgggaaacctcgggaaacatggcaggctgtgttccccatcctcaggctcccaagtcgcttctgtccagtcctctgctggtatctgtgactcagcaccatgacggggccctgtccagggcgtcctgggcagaaggctgctccgagtgcacagcgggcacccccatggacaggctgcgtccatgtgccactccttggccgccctctcttcatctgtagtgatgacacagtgacccccacctgcaggcctggtggcactgctgtcaccaggcacagggagcctgcccccaacctgggtggtgttgtgggagtggctgggcaaggaacgctgctatccctgctgagctgggtgggcactgatgggcatggggacctggagtgctgacccctagccctactgtcggcaggccacgcctgcccctctggggaactgctgtgtcccccttggctggcctagaagtgcctagaaatgtcttttatgtggggagtcggtgggtgagggccccactgtcccatcccttgaggaagggagggctctgggcagggtctgcaccaattccccagtgcctgctgaggcctgtggctgcctcagggacagtgtcagtcaccccttcaccctggcataggtgtcctatttccagagtgtagtgctggatgcttctgtttggctgtgttaattgagaccagcttttacagaatgagcctcttggggtgggaaaatctgcacagccttggtgtttagggtaacctgaaagtggagagtgagcctggggtgcagtctcactcccccatgcccctgggcacagctacccacaggcccacagcaggcaggcaggactgatgccatcctccagatcccccgaccaggcccagaggtggggccaggagagatctggggagttggtgccaccagatttcccaaccatgacaggatgtcggggggtggggggcaacagcaggactgccccaggctgggtccccacccaagtgaggcttggtcgtggcctcatggccagtttgtccctctgcggatctggaggggtcctcggctgcagcagggggcccagatgatcctgacctggggatgggaaggcctctgtccgtggttccccagcagagcggggcctgttgagaggagcaggggatggtctgttgaaggagtcggtgaacggagaggcatgcagggatggatatggacagggcgggtgctcagaccctacagtctgaggtggaggggtggggttggaggctggaatggccgcgggggagcctagaggggtagggctgtggctccaccactgttggctaagggacctcagggagggcttcagaggctggggccctggctcccaaggcctcaagaccctcctgctccccctgaaggtagcagtgaccgcctctcagaaacccctggcatccctggaggctgcagtcccccgccccgcctccactctttctctctgctctgtcatttttcaaaaataattgtgcagcagcaccaggctgtctctgtgcccctcctgtaggttgccctaccccaccaggtccctggctcggcgtccccagactctgccaggctggcctcaccgtgtgtatcgaggtgttctccctgcaaggtcttcatcattccccaattgctcgcatttatttttctccttccttggtgagtggccctgccagcctcagccttgtctctccttggtgagcgtcattaatgcagcttccgcgccacgatcagagggggctgcccccaccctgccggccctgccgcttctcctctgcccgcctcgggatggatgttcatttattgcccataaatctctgcacagccctttgtaaagacaaattggaggcctcctgttccccggtgttggttgggccgatcggtggtgggtttaattggcccttcccgtggaggctgcccctgcaggagaggctcgttgtgggctgggccagatgcactgcgtctgcagaaggggccattctctgcccctcattttgtctagcgtctgaggctgggccatgtgcagggacaaagtgtggatcctccctcgggcttccaaaacatggcctccccgcattcacgtggcctggcagcagcccaggcccaggcagggccctctctcacccagggggtgatgcctgcagcttcaacagcaacctccaggaaggaggcgcatgggttcgttgaggtgatacaggagtggaagagcttggtcccttgaaatgaatgatagggaaaaggggaagtgctgcgtagaggagggtgtgatccctggctggggctccatcccacagacctaggtgaggacaggcatttttgcatttcccaagaccaccctggcctgccacacccccatcctatgactataaaaactcgcgagaccctggcaggcacgcacaagctgctggacgtggagaggagcggattggcagaggagcactcaggcggctggacgtcgagaggaacgcactgacgggcgccggcaccccggcaggctaccaaccggcagcagaatgacctggagtttggctggggcagccagaggagagcccgggcccgactccaggggaaaaccgtcccactccatcttcttctgccttcccccatctgctacctccactcaataaaaccttgcactcattctccgagcccacgtgtggtccaattcttacaccaaggcaagaaccttgggatgcagaaagccatctgtccttgcgataaggcagggctctaactggggtttaattgagctgagtaacagaagccaccgatagagttaaactaaaacagcaaaactaaaagagcaccctgtaacacgctcactggggcttcagctataaacattcacccctagacactgccgtggggttggagctccacagcctgcccgtctgtatgttcccctagagatttgagcagcagggcactgaagcaagccacaaccccattgcatgtactgtgaggggaacaaggggacttttcctgtttcaccagcacacagcaggtgcctaataaacgcacagcgaactggtcagagagagagggaccctccaccgagcccagccactgcacaggctgggagggcaggactcctgccgagcttggcaccctttcctgcacccaggtggctgtgagcctggccctgccccggtcagcaggcctgtgctgaccccacatgcaatctgctgttggtgccaaggaagtgctacctgtgcagctctcagaatgtcaggctgggtgctcctccactgaggtcagggtcaagagaccctaggccagctctggggggcccacagggcgtgaggggggtccaggcagccagcccggcccagcctggttccactgcttactgtgtggccttggggggctcccttggctttctggggcctggggaaccaggcgcgagcttggtcctgtggtctgaatccaagaagacaggttgtgggtggggacatttggagggagggacagcctcggcctcagctttgggaccgtgtggcagaagcaccctgtctggccctctatgagctcctccagggctgggcccaagcagggacctcttcttccatgagggtttactcattcctcaaaacaggcacaaaagcagagggctgttgaggggtagtgacctgcccctggctctggccatgcgggtctgggcactgtggatccactccatggccacctggctgggtgaggaccagcctggaggatcaggaagagcttcttggagaagggagtggtgtcagaactgaatactgagcaaagaggaaggaccaagaagaagatcctaaggagttctggggctgggggctggggattgggagcaaaaggagagatgaggctggacaggtgcctgttcctccacccactggctcaggactccaggcatggcccagcaagggtcccctgcccctgggagcaggactcccctgcagcagacagaggcaggtggggagtgcgacgcacctggaaggggcttccggagaggtgtgccctggcagagccccacctcccccaggaaaagacagtagcaccaggccccagccctggagaagcctgaccaaccagagaagtcccacggcctcctccatggagtttggggctcctcctctagacctgggattggcactttggggtcaggccagctgctggggagccctgggccccgacacatgcaccctcccaacaggagtggggctccgggggccactgggctcatgcccatcgcagccactctccaaggccttggcataatgggatccttgagctgctgtgcccggcggggtggggggggatgggctgagatacaccctttgctgacagtggccattgcacttttcccacccaggcctcatgtggggagccctgccaagcccaggctgtggtgtacacaggggctgggctgcagggcagggctccggagcggcctagcccagagcagggtgggaaaggagccagctggggtccaggcagaacagaggccaaggccaccagtgagaaatctgggcatgagggtggccaccaggccggcaacgtgggggaaattgagttgagggctgggcctcctcactgtggctggaggcggcccaaaggccagctgaccagacacagagctgcctcagtcacagaggtgccacagctcagggtgccaccccgagtgacatccctaggctgactgacacagtggagggaattgacacccagggtcttgtgatgtccccgggcactgggatggagaagcagagcagcactctggagcacaaacacagttggcagcgaagggtctgctcccgcgtggcctcgggcccaatcctgcctgacatgttgcttcatgtctctgggcctccgtttcctcatctgtgccctggggacattagcagtgtcttcctgcggggatgtgagtgtgaggtgccctaccaccccagggaggctgtgagctgcaggcagcccggcagtgaggagcccccacccctgccgccgccgcagtggcccgccccgggccccagctcacaccacaaacacttgcctccctctcaacttgtttccggcatgttctcagtctcgctggatgttagtttaccatcggctgctgaacattcggcagcttctattatttcagaactaatttaaggattaaaaagtaattctcccaattactaggcaaagccctgggcagccagataaacagggggcaggcgctcccatccaaggacagggctgctcctgcagccctgggcagacaggtgtgcagggcagctctggtgcagctcagcccccagggccgcaggggtggagtcggggtggttgagaggaatccccaggagcagcccagcctgggcccgacatctgagggttgcttgcccctatcccccacccaggtcggctacagccacctagtggtgagcccagccccagctgtcacctccaccaattgtgctgggtggtgctgccctggctaggcctgcaacacagggacaggcccatgagctgtgaaggattcggtccacagggccccctggggctggccaggcatctttggacggggccaggagagtctgtggtagaccagcagcccgcatggggtgggggccaggatttgataccctcaaggctgattcacgcagctttaattagctttctgcacctgctctggggtctgggtgatcaaggctggacaccagctgccacccccaacccctgcctggtccagcacctgacctcaggggcccagccggccggggctggtcaggcagagctggggagtgccggggtcggcgcaggaaggagctgagtccctgggccctggcccaacgccccgcccactccgggcccctcgtcagcagcggccggccggtgagctcatctcttcctgggctgtaaatatcacccaagtgctcacgactcccaaatgtgtcctccagccgggcccctctgctgagctcagcctgcacagcccacgcgacacccccgcccagatgtctcctgggcctcgacaaagcggccgctcctctcggcgcccccacctcagggacgggcgccccgtgccggctgctcaggcctgggagccctgcctgccgcctccaccccatgggagcgtccatgcatcctgctgagtccaacttaaaactcgtccacttccttccggatcctctcaccccgtcctcaggtctggttggactgtgcccaactccccacccctgccactgcacaggcccccactgtggcctggaggggagggtgcagagccctgagggcagctggtggtgacagtcagccccgaagctggcctgagggcgacaggtgcctgcttcttagttaggagtgggcccagcagaggtaatgaactccttgtcctgggaggtgtgcaagctgaggcaggatctgctgtccttccacaagccattgagggcgccagcatccactgcagttgggtcactcaggtggggctcaaggctctttggaaatgggtggcttcggtttcctggctctgactgcaaggagcccccagcctcagctgagagcactagcccagatccagcagtttagctgcctcttctcaggcatgacaggggccacttgggagaaaaactgaataaaaccctgcctatgccagtgcccaggcacagcctggcagaatcctgggcctggctgtggggtcacagagactgggggtgccaggggtgctgatggtagagctccaggcacaggacagagactgcacaacattttgacatcaggccatccatggagaggcctctgctggggctgccaagggtctcctgggcccagaggggctgcagagggagccctgggcaaacagcaccccaccccggcagggctgccctgcctgagctgcccccagccttggggcaaggctgccggccctggatctcaggtgagcagaggggcaaactgcaggtggaggtgtgcgcagccacacggggggcctcagcacctgtgggcacaggcacagggtctctcaggagagacaggacatgtgggaggaccctgaggagggtacaggccagacaggaccactgcatcctggctctgccctgtgcttgatgggaggggtctgagccttgggccgcagcacacgcacagagaagcgggcggaggagctggggccttggctgctaagcgcgtcctccccgcttcttctccctccttctcctccccccaggcttctggagccccggccgcccccacgaccatctggcttcaccagcaacgctcccccacaccctcccccacgtcactgtttttctccctctccccctccccagccactgccctggcggggagggggccctttcctgggaaggcttcctggccacgtggcccttcccttttgtttctgagtcctcttcggcccaggccgtgggaaagcgtgcctgtgcatatttctgcctgtgcatatttttgcctggatgcgtgtgctgctctcgagcccccggtgcctgcatgtgtgtggacatgtgttccctgccctgctgtgtgtgcatgcgtgtatgcatacatgggtgcagggacatgcagacccaccacggcctatgtttggggtgtgggcatgctgtaagtgggggtgccccagacacgcatgtggggtctagtgtgaccaccagcagcggtgtgagggtgcatacagcccccactgggccttgaggccaggcctgacccgcccaactctccttcagggccttcctctcctgccacccaccaggggtaggaacagggtccctcatcctcagcctcctcctgggggctgcccgggcagcctgattggggtggggggcccgagagcaactgtccccacaggggctgctatgtccagacccatggacctggcatgtgctccatcagccaggctcaacgacgtcagccaccaagcatgctccatctgtgcggctggggggccaggggcacctgacattggagctgcccttggccaaggctgtcccacctgtggtgccaggcaactcccttcctctgggggccttgtgatgggggagaggctgcccgtccagcacccacccctgcttctcaccgcccacagcaccctagcctgagaggccacagcttaagaaaagagctctttattccacgtcgtccgatatttttacacaagtaaaataaaatgcatatctctatataccgcgatctgggtgggaggcggcgttctggaacaaacgctgccgccgaaccctgtaaacatgatggggtggagatgggggtggcgggcggcaggcgtccatcagggaggacctggcctggcctgccccacgggtcggccgcccggctggcttggcggcgtggagagagaccccgtatgtacacacacctggctgctgagcacgctcttgtgtccgctgggggtcagcagggcccaagcactgtccacagcaccagcgccaggcccaggggggtgaggctgcaggtgaggctgggtagggcacctgagccttctgagtcaccagtcccgccacccccgctgcctgcctggcccagacggcagtggctgcgggtgcggttcttgcgtgaacagcctggcctccggcgagggcccgaggtggggaaccctggtggctcggagccctcgggccgcactgcagtgagcgggggctcagcagagccaggcagagtcccaaagggtgagtcattgatgtgccgtgggccagagccgttgcccggcgggctgtcaccgggcggcacgcgtcccttcagcgcattgcctgccgaagctggtcttccaggctccagtactgaggccttgtcagcggcatctggctggcagcacttgggaagccccagcggctcctcatcggtggccctgccggtccagatgggatggtaagggccggtggccacagcgcagccctgcaggtcattggcagctaggcgtttgaggtcacggccagccaggcgttgcgggaggctgcagggcacctcggaggaggagccgcggaacttctgcagccaggcccagagtgggcgtgcccggcagtcacacacccaggggttgtcgttgagcctcaggtactgcagggcacgcaggggggccagggcctcagtgggcagcgctgatagattgttggcaaacagatagagtgtcatgaggcggccaaggtcacggaaggcatgcgggtgcacatgggccacgcggttctggtgcagtaggagacggtcgaggctgtgcagcccacggaaggcgcgctcgggcacgctggagatgcggttgccgtgcaggaagaggtgtgtgaggttgcccaggtcgcggaaggtgtcatcaggcagtgcctgcagcgcgttgtcctgcaggtagaggtactgcagggcagccaggccgcggaacagccccgggcccagctcctgcaggccgcagcggtccaggtgcagcgtgtgtaggcggcccaggccgtggaatgtggcagggtccacagaccggagctgtgcattatcgctgaggtccagctgctccaggagggccaggccagtgaaggcagccgcatcaattcgggccagcacattcgagtgcagccacaggatggtgaggttgcggcaggcacggaagctggcagctggcacatgcgagatgcggttgccgtgcaggaagatgcgctggctggcagcagggatgcccacgggcacagcctgcaggccctgctgggggcagcttgtcgtcaccttgggctcattgtagcatacgcaggcacctgggcatggggctgccacctgccaggcctgcagccacagcacccatgccagcagccggctccctgtgggcagaagacagagtggttagcaggaagggcaggggtactggagaagctggaggttttgctagagccaggtgggccccggagattgggtctcaggaggacctggggctgggtccaagatgtggccaccacccccgggaatcgcagtgttgggatccctgcttcacaggcctcatggacgatgctgggctagaacatgccttggagccatgcactccaccctggaagccacatctgcagactccccataccacacccaggagcagcccactgggtcaccaggggcactcacttgaaggcctcctggaatggacactggtgactgcaggtacctcctcaggactccagtgaacacagagcccgcattgcaggagtccccggggggtcccagtgggggttccacccacagggcctaggaaacactgcaatggggctggggtccctctgggcacgtctatctcaaaaacgggcgcctggatgcccgagggcgggggtggagggcaagtgtgtccagggcttaggaggagtcgcgtcccacaaccacccaggcagcctgctccctcctccacacatcctcctttcaagcacttcctgacttggcaggaaccctcctgaagcctccgccccctggcctcattctctgctccatctcctccctgggaggagttcactcctccccagccaacccctgcagtgccagctgcctgcacccctcccacccagacgccatcagcagggatagcctcccagtgggttctcccccagccccaggtgcctgcaacccctcctccattacagggccagatacacctggggcttcaccaaggccctacatgggcagtagtccctcccggggtgccgcatccagagctggtctcaccagcggggtcacccactccggagtaagctttcctgcctctcattccaccattgagcccccacccctttggaatgctgaagattctttctgccttcagcagtgagtctattaaaatgtgaatccccctgggaaggttatggcttatcagctaacacttgagttatcagctaacacctgcgttgacagctaacaccttccacggcagctggctaagagcaggattctgcagacatgaggccggctaagtgctggggttggagccgggcaggaggaaggagtggaccacaggccagcttccccaacctagaactgtgaccctggggccctcctacccacatggggcccctgccccactgggtcctctctacttgggcagacagtgcagtcgccctaaacgcagagcccagcaagcccagcacgcgcagtgaccgctgggcatgtgcgtcctcccagactcaggttcataggtcctcagaccccctccccacagcctgggggcctcctctgccaaaccccctgccccagggccatttgttggctaccagggagatggcagcccagggatgggggtccggaggcccctccctgggtgggctgggtgaggaaagcacctggcctcgtgttctgtttaaactgcggacaccctctctgctctctttctacacactcttcctaggaaggtggggcctgaccatgtcagctccccactgctgtctcacctgctgtcaccagagggaaaactgtgctatgtaaatggcacttcctgtcctggggccaggtggggtggaggccccacatgctcatggggcagggtcaggactcactgccacattatcgaccacaccacaccactgactgtgggggtcaccaactgagccttgtcaccaaccataccatgcggctgactgcacccaccaagactagccacccatggtggccacgcccgccacattaccactgagccatgccaccatcccaccactgtcctgtggctccaggcccgaagctgtgggctgtgagtctggctgtggtcagggctcagctcactcgccttgaaccgagccctgtgctcatggatctccctcccgaagcagctgtgtgtccactctaaacatgcccccagtgaggtgccagaactgagccacacggtggtgcggggtcgggggagacaggggaggacatgggggagtggccacgtggcgctcagttctgccaggaagtgggtattgggcgcaaagacacggctcggttcctgccgagacaactgcttttcgtaaaccaacttctgagagtcgggtgaggtgggctctctcctcgctgcagccatggtaattggctccagcctggccccccttggggcctgcccgctggtctccatggcaacccctctgctgagcgagcaggagggggcatctttttatgagataatcaaacccaactttgcagcatgggtttgtcttcacagccggggccctgggatgagggagacgcagccaggtggggggagggtgtcctctgaccccatcccaggggccagactggtgactcaccagcctcctccctggccccatggtggactgcagcccctccccaccccaaaagacctccctggcccgtggcccctgacctgtcccctgggctctgcagcctcaaggccacaaggcctctctggccctctcgcccacctttctctctcctctatctgcctggccaactctaataggatgctctactgtccttctggagatagcatggcctccctgcctgccatcaccccactttccactctcacccagtctcaccctggccccagttctcacggagcctccagtatgagctctgtccttcctgccccttgcacacggggtgagcaaccagccctgccatggccccagctctcacagagaaaccatggatagcgtgcctgtccaccgtccccacccaggttggccctgcggccacctgagcctgcgagggccccagagggctctcctcagcctccaagctgcacacaaactggtacatctgtgcctctcccaccctcccaggccaattaacatctcttctttcctccagggtctcctcctgggacctccccggaggatggccctgctggctgtcagggctgggtcatagctaggagctcctgtctcagcccaggcctggctcaggagccacagtcaggggagggctggctctcctgcctggaaggctctgagctttcccagcggggacagtgaccggatactgacccagagcctctccctgcggcagccagactgggcagggtaggacccaggatcaccaggctgaaggcccaggaggctgggcagcaaacagtccaggacgcatccccctgacgggagcaacaggcagcccaggtgggcacctgcaccatcagttctggtgagtggagggctgttcacgttcactgcaggagggagtgtggcggggggaggaggaggtgggaggagagcgaggagggcaggagcagaggggaggggtggagaagggggatggggaggtggcggtgggaggctctggggatatgcccagccattgggcaggcaggcggctgctgaggtcagcagctcaccccagcagcccagggagctgagccgagccgagcagggatggccttcttcatgtggtccctggcccccactgttcctggggccccgcccacctccgtgccctcccaagcttgggctgaagttccacagggatgcctttgcctctgcccagcgatgccaggaggcagcacagggcaggcagctgtggaggcgccgagcaccggctttcatccacgcacagcttggtgccctcgggccccaatgccgcccctgggctgggatcaccggagggtcccatcacctgctataaaaagtgagacagcaatacatttacagattaggaaactgaggcagtgagtggttaagccctgccctgctcccactccagactacccaggtggagaggcggccaagggagacactcacagtgctgcccggaggggccacgaggcatgtcctgcccaagcaggaaggctggcggcctggctagtaatgggggagggtgtggaggggctgggctgcaggccacgtgcagaggggcaggcagcgccctcctgtgtcatgggtggccgggaggggaatctccagggaggctctgagctgctgcttcccagggctggggtaagaggctgcagagggctggggctgggggtgggaccagctgtagcacagccgggacatcagtcagctcaggatcctctcggacaccagccatgtccccgtcaggcggtcacgtcacagaccacagttatgaggcagaacaggaggccacagctcagtgcaccaaggccagaaatagctccaggcgggggtggcgggcctatgtcatccccacaccacagagggtcagggcacccctcccacgcctgctccccactcctggccctccaccactgactcactccccccgccccccacccatctgtcccccgatcctcgcttgcttctcacatgtacacccacccgccatccatcctcaggcccacagacacgtgcaggggcagccagaattcccatggtgtttcctgtgcccttccagggctccaggtgctgcggcaggagattggcagcagcttctggtgggggcagtctgcccttgaggggtcctgagtctcctagggaagtgagtaccagcccctgatgccctggccctggcccctgctccttgttgatcttggctgcaggggcagggtaggcagaccaggtcaataacaggcaaggacacctgccatggtgagaggtcactggacccagactgaagcagctccaggcctagctagctacatgctgtgggggaaactgaggcccagtgtgggcagagccttcaggactggcctcctgagtgtgcctagtgcttcctcagccccctcggctccactctttgccctggccggcagggctcgtccctgccccgtgatgctgggctcaccagagacaacgagatgtaggtaggtccagggccagcaggccaggccagaggctgggcccttcaatccagcaaattctcttggagggggtgtcaagtttattgacccattttacaaatgaggaacataagaactggtgtgggtataatcaatagcaaacacaatccaaggtcaaatccaaccatatgctacttacaagaaacatgcctaaaagtacacaaaatcttgcaattaaagatattatcagaaaaataataacaagtaaagcaggagaagccacagccccagggctagcgggcttcccagtctcatggccccaggggtgcgaaaaggtcttgctgggcagtaaaggctcagccacccccgctcctaacctgagctccacagtcctgtttccagccagcagggcacctgagagggtacacctttcaagtcacagacactgaagctagcagaggatggcctggcccaggtgagagctggcagccctggatggcaccctcaccccaaggacacatcaacgtgggccacaccgtgcaggatcatccactcgcttggccctccctccgtaccttggcaaggtgtgaagtggcccctgtcccaggtgctgtgctgagtgccgcccatacaagaccaggccgaggagccgggtcccaggcactcacggtccagggccagctgaccacgggcagccaccctgctgcatggcaggtgccctatgggagagttaggagccacagaggcctgagccagccccaggcagcatgaggatgttggcaggagcccaggagcccactaccagccaaagggtcttggcagagccccaagtgggcaggatccttggcctagcacctaggcctcgaggattcatctttggtcaatgctgggctgcctgcgtggagggctccagaaccttgccccatccagcccatacacccctcactggaggtgcaccctcctcggctcccaccccagtgagccccacactgggggcccctggaggctctgcccagtggaggcctcgcccagcccagggcacagccagtgcccccttgccccacaggaggcttgagcccacctgctcctccatgctccaccaggagccaacaaacacctgctgcctaattatctggagaatcctgtctccaccaagggctcatcttggtcctgcagctaattcaatccagcagccagagcaagctgagtccccagaggacactaatgagcaagtgaccggtggccggcctgctcccaccctggggacgcactctgagccaggtctgggcccagcactgccatacacctgcctcccatgcccatctgcctgcctgaccctgcccgctacctggtgcctagccctgcagggcccacatccactcccatgggctagcatccagacctaagccccagccctcccacactcccccaggaccctggatctgctgcatgcacaaggctgaccactgcctgtgagcccagagtgtcggccttgacagggcaggaggaagtacaagagcacatgctcagggtgcacgagccaggagcacagactcagtgcatgcaatgggacccctgggggtgcacacgataggcgtgcataccggaaacacacaataagagcccccagggctggtcagggctcaggcagagtccactgagcagtagagggttgctgggatgcgagcccctcccaggagccagggcccggctggagggtctgcatgccgctgcggcagaggaagatgtgtaggcacatccccatgtgttctcttgccctcagcatttgtaaaacatgatcaaccaggcaggcgagcggcctctgtccgagcagaatttattctgctgtgaaaagacacgtgtgggtcctgaggctcttgccggcttgttctcagcagccttggatcagcctcagtcagcagaacagcagctggacaggctcccattggagccatcccagggactgcccagcccttcacattagaaactgagctgggggcagcagctggcccacggcacataagcagtgcctgctaagaccacagagaagctcagccaggcagggccagtgggatccagcactccccaggggatgaggaatctaagaggcaggagaggatcctcctcagcctgggatgttcccattggaattcccccagccaaggccagagctccgtgtccgggggccagagtggaacccttgtcagagccgacaggccttggcctcctattctactggcacctggcaaactggcccaagggctggctgctgcttctgtaaaggatgtgctattggcagccagccacacctatgtgttcacgcattgtccatggctgctttcccgcaacaacagcagagctgagttgttatgacacactgtgtggcccacaaagctggaattatttagtatcacaccattcacacaaacagtttgccgacctggtttgtgagcaagccgagtgtgggtgctgccaccttcaccctcacaatggccccagcagttcactcagacccccactaatgaaaaggaaaccaagggtcagagaagaccacggtcctgctgaagtcacatagccaggtgaacagagcccagcaacctcagtgcaggctcagctctgtggagacctgggcaaggtcagcatctcacggaggcctagggtgaggggttctaggcaagaaagagactcagaaatactgaaatactctgcaggtcaaaacagaaatgatcatttttctaaagaggctgtcaggagtctcacagtcaaatatgcataaaataggacaacctaacacaaataagttgggaggggtggctcacacctcagcctcctgagtagctgggattacacacacacacatgcatgcacacacacacacacacatacacacaaagagaacaaaatggttgtaaggagagggggacagcagaggaagtgctgaatgacacagtccggcttcggaggaaaggacttgggtggcacttcagaggagacaaatccagtgcaggtagttttgaagagggcagccgtttaactgaggtagggggtctctggggacagggcccctccatgccagtccacccaccttggaaccctgcagaggctgggccgaggcctctccctgcaccttgtatcagggactctggccaggtcacaccaaggtggcttatgacccattaacatcaagctgcctccctgggctggacagggcctggaaagaggtgacctgggcagatccgtgtcgatgtacttcccaggacatcaggattccagcctctgctaaagggatcttcacagttaataacaaagaaatattaaagatgagaacacttggtgcaggaaacaagagaggaaagggagtgcggtccctccttgcaaacaggatgccctggaccaccctccacggcctcaggcctggatgctcctgcagacccatagccaagattgtgaaggaaaagtaggctgtggaggcattttctgtccttgttatcatcattgtaaacatactcatcatcaccatcaccatcctcatcaccatcaccaccactatcaccaccataatcatcagcagcagcatcatcaccatcatcaccaccactatcatcattaccatcctcattaccatcactatcaccaccatcatcttcatcaccatcctcatcaccatcaccatcctcaacaccatcctcaacaccatcatcaccatcactatcatcatcaccatcaccatcctcaacaccatcatcaccatcactatcaccaccactatcatcctcatcaccatcctcatcaccatcaccagcctcaacaccatcatcaccaacactatcaccatcattatcatcatcaccatcctcatcaccctcaccatcctcatcaccatcatcactatcactatcaccaccatcatcatcaccactatccttatcaccatcatcatccccaggcgaccagagcagcaccatccttatcctcatcactatcaccatcaccatcaccatcatcaccatcctcatcctcatcaccatcatcccatcactatcatcaccatcctcatcacaatcactatcatcaccatcaccatcctcatcatcaccatcgtcctcatcaccatcaccgccatcagcatcctcatcactatcatcatcaccatcctcatccctgtcaccatcatcgtcttcatcatcatcaccgtcatcatcactatcatcacaccagctctgtgcaaggcccttagataaagggcagcctggggctgacctcacacaaggataggaagccccaggtgagcaatgggtcagtactgggtcgacaccagatatccctgggcagaggccctggcccaaggatggggaagggaagaggacaagggatggggagtaagaaatgagggcccctcgcctccctgggacagcccaaggtgcagcctttcctcattcctggaggtttcaggatatccctgtgctgcatcctcccattgtacggtgagggggtgactgccaacccactcctcagatgaggcactgactgaggcaagtgccttgctggccaccttgcaaggccaggagacagtgcacacaatctggactccaagatctctgcccacccccatcttcatcaccactatccttatcaccatcatcatccccaggcgaccagagcagaccctgagccccagggatgacacagcagggaggggcagccactctgggctccccagtcccccatggcacctcaacctcagcccaggaggctgccctcccagggatggctgaaagtgggccctggggtcttgcagccctgggctcagatgtagcctctgcaccccctcacagagtaggcagagaatctgccagccccctccaaatctgtccccacaccagtgatgtgaggacaatgagaggccagcacctacctccccccaggaccccaaagaaaccccacccaggcccccacccagcatcctgcctccccagaggcctgccaatgtgacctgggtcagcctcgtctcaggtgaggagtccagggaggcaaggtacagctcacagcgtcccagagccacacggacccctctgctccagcggtcttgcaaggccactctggcctggcctggcagtagccctgctttattgaggagatatggcaggcaggatcctggctgcatctgggctggaagagggggcagcagccaggctgtgctacaaacccacctggagccacttcctcgctgcttctgcccatctcagcctcagcagagaaagaaggcttgaggacaggcctggtgcagcctgactcatctcatgagagacccggcctgtgctcagagtcgagttgctgtggcttctcatgcaacactgatggtccccctcccctgctcacccaccatgtgttagacacggggatctgcatgaaagacacgtgttcctccccttccagagacccaccgaaatgagggtgatgcagagtgaggagtggggagcacagtggcaggctgctcccctggagaaacacccagagaaaggggttccaccactggtatccaggagcacccagggccgatgggcagaagaaaagctccatctcagcagagcagccaaccagcttccctcataaaagtgaccagaaaaccagtgaccaccaggcatccggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctgctatgaacaaggaggcatcagacaaaaagaaagagtgcctggaaattaaaaatagaatcactaaaattaaaaaaaaaatcaatacaagtgttagaaaacaaggtcaaagaaatcttccagaaagaaaaacaaaggagaaagacaaatgaatgagatttgggagacaaatataggttgaacatccaaggggagttccagaagagaaaacaaaaaaactgagaaaagctagcaaagaaacaataccagaaaacttcccaaagctgagtacccagtcctccactgggcattcacagtgcactttcaggcccccaggggtcaagggaagtctgaagctccaggaggagaagctggtcacaaagaggcaacacgaagccatgagcagcagtgcacgccggtaatcccagcactttgggagactgaggtgggaggactgcttgaggccaggagtttgagaccagcctgggtaacacagtaagaccctgtctctacaaaaaattaaaaagttagccgggtgtggtgatgcatgcctgtaatcccagctacttgggaggttgaggtggaaggattgcttgagcccagaagtttgaggctgcagtgagccatgatcatgccactgcactccagcctgggtgacagagtgagactttctccaaaaaaacacacaacaaagaagatgcactatggtattggcctccttcatagcacactagatgccaggaaacaacaacactgcaacagcttcatagctctgaggggaaactaatttcaacatggaattctagaccgaaacaatccagcttgaacatacttgtaaatacaggaagacttccggaatgattcttcaccatatcttctttagagagtgagtcaggcttatgtttcagccaaaatgaggtgcaaacccagaaagaggaaaacgtggggcccaggaagcattaactgaaatttcaacaggtggtaaagggaagttatggggcagcaggacaagtgcttggggtgaatctttatccagggaaaaaaatgagaccccaatagaagccctgatgtggggaagagtaagcccatgagggtggtggatgggtaaaaaacatcaactgtaagccccaaggaaaacaaaaggccatgaaagagaaggaaggtcacccatcccacggcaggattgagaagaacatttatgggacctgggttgggaaacactggctgtgaatttaactgatggcagcgagacagccatgctggggagtgtgctggaggagacagagctggagtagaagctgaggaaatgtggcggcaaccactggcaaagccagggaacagaggcgacagtggctgcctcccaggaggacgcggggcaggggcagattgagcccattctccagaccagcctccgaggctgggtgcaggtgttaactctgcaatatgttgttgaccgaatgttattattttttaaaacaactgcatatgtggcactaaaatctcagaaaacagataaataaaaagaaaaaaaagaaagtgtatcttccagaaggtggagacaaatgtaggttagaagcaggtgtctccaaggtgcaggaggagagcgagggacagtgagagctcaagagcacctggacatacagccccagggcagctggcatctggccagggaggatccacatgctgctttttggtcccctgctcggccaagggtggctgaggatacatctgggtctcccaggacactatgggctcttggccccagagactctgcaatccagacacccgaaggggcagcttctggcctaaaagcccaactctgtgcttgggccttccctgcaggccaggcagctgcttccctgaaccagcctcagagttcctgcctgcccacccagcccagccctcacactgtgatgaagccccacccctggattccccttacccctgcccgctcctgtcccctccttgtcacagatctgagccccccactccaggctggggcccctcaggagccgggggtaggggtgtgcggtcaacacccagcaggggtcgcctagcactggggtgggtgtgcagcccccagcctcctttctgaccgtgcacacgggcttctctcagctgctatgagagcccccaatgcgtctccacaaccaaaccgaggcacgcacgcagcggcgacgtgaataagtaattgctcttttattaacaagtgataaattattcctatatgattgtgtgtgataactcttccttatttgaaatcaatttgggatggaaactgttgtcggcttctcatccacgagggtgggaggcccaggtgccgctgcctcttggaaaacgaggtcagtgtatttcagctacttcctgaggctgatgcgccgccccactgcgcagggccagtggaagggggtcagctgccctccgggaggcggggcagtccggccttatttcctcagcatctctgtctgggacccacgccactgagcccagggcacagaggggtccctcaagtccaaggccacactgggcgtcaccacagggtcatcaggggtcagggggccatgcacaggccatactgcattcatccccccatgtaagccccaaagactgggcagcctgacctttcatcccacagaggacactccagcacccagctggtctcctggcctgcccgggccaccccacggtggcttctcaaacctgcaaaggcataagccattctcctaaaattgtcctgatgattttacaacagccctggccccatccccttttcttcctcccccagcctcacagaggagggttcagggactcagcctgttcagggcagcccctgggccaggcctcagcacctcttctgttaatgcatatttaaaaccttgcaacccaccgggcagccagccagccggtgcctccctcccaggccaggcctgcaggaagccatgccccgtcccgctcactcctccactggctgcttctccgaccccgatcatggctgcagcaggcctggaggcccggtcacccccaggcccagtcacatggccctactcaggcaccacctgtgcttcttggctgggtttctcatctgagaaatgggaaggctgggtctgggtgaggcacttctgtgggcccactcccacggtctccttgacacccctccaccttctgcccactgccagggtgcccattccactccacacctcgctggcccacttagcaggcttctgtgtagcttgtttctgtcggttgaggcaccctgggctttgggctccacaggggctggtgacccgcatacaggaggtgctccataaatgttagtcatgtgaatgcactaaatgctcaccactaagggcaagtggcaggctttgtgcagctatagagacagcattccccaggatgtccagccctgggagagagccttggcccacagcccatgaggcaacggatgttcctgggttgggggcatggctccagcaccccagtgccaagggcacggtctctaagtagcaacatggatagctttacttctgttacagctccatgtctgcgtctcccccagattcacgtgtcgaagccctaacccccagtgtgatggtatttggaggcggggcctttgggaggtgattacggttagataaggtcacaaggctggggccctcaccatggcattagtggcctggaagagaaagagacctcagagagtacatgccctcctctctctccacccttccatcccctaccacgtgagggcacggtaaggaggtggctacctgcaagccaggaagggaacttccaccagaaccagcccatgctggcaccctgatctcagacttccagcctccagaactgtcaggaaatgtgcttccgttgtttaggacaccttgtctatcgtattttgtcatggcagcttgatcagactaatacaacttctttcttaaaactttggtgtatttttccagattttctacaatgaacatgacctcataaaatcaagagtgtttttcgtttgttctgtttggtcttatgctgacactgggccaggtggaagggtgggtgagtccgtcttgcaggtggcaggagccccctccatgagcccccacaccccagggtccctgcccaacgtgatcggccctgcagggcagtcctggaaccagttcagggcttggggccctggctctgcctagggaggtctcaggcaggccccccaacgtctcagaactgcttccctcagttggaaatggagataataaggcccacctcatggcacccacaaagaatggggcagcctgcacctggcctctccctggaggaccttctcacatcacccccggagggaccaccatccccaccccacagaggagaaagcccagctccaaggccaagttgcagccaggaagtgctctgctggcatcctacctggccctgacgccaggcctgaagccagcaccacccggggctctgttgctccaaggccattgcccctgctggcgtttgctcaaggagctccccctccagaatgccctgccctattcccagacacacttcctctggggggctcttctcccccagccccacccctgccacccctaaggaggctggccccttcccaatcccttcctcgtctgcaccactgccttgcccaaggtgtccatcctcagacccaatggggccaccatgggagcccggctgggtaatggcccataagctcctgcccatggagtactcaggcagggaggggcacaagcttggctgagcatgagtgacaggctgggtgggtctcaacctcaccctgggcctggggtagccccttgcaagtgaggatgttgaacacggtggacccccaggcagaaagtgagccacggggggctatgcaggactgcagccctcccctcccctcaattcactggtgagtagcctgctactcccctggctcccagggcagggccctcatcacctcgagacccagaagcagtgatggagaccgtcctgcaacatcaagctccctgtgatctgggggccaggggatcctgagtaccctgcctcctggagtgctctgcctgcagggggcagtagcagcaccttcaggtggggtggttggggtggcttcccggaggaagtgataactcagctaggagtggggcgtgggggtggtcctgacatgtaccaaggctgggggtcaagtgtgcactgtctctcagccaggagggtggaggcgctggaccaaggctgggggtcaagtgtgcaccgtctctcagccaggagggtagaggcactggaccactggggcctcaggtgtccaggtcacttgtccctggagtccctggctatgacagaggccctggtgggcagctcggggttggggacaggccaaggcataggggagggcacaaagggaggttggtgccccacccatcacccatcatccgcctcaggccaccccaggggaccggcctccgctccggcagcgggtgaagaatggactccattagggccgccatctgtctcagccatgacgggtcctcgcggtgacatccgggaggtatgtagatggaatatctttatggggagagtttttcttttgccagttttcaaataggaagccagacacttgtcacacctgtccctgtgtcagcctctgcctgacataaattggggccgaggcagggagatgaaagacagcctggaggcagccgggtgcgcagggcccatgtgtcaggccgagggagcaccagagctgcaggcagcctcctgctggggccaaggagagctcgccccgcagtccacctccgcagcctctgcccctccctccactcccctctggacccacaagttcttcacctgccctcccccaacccagagccctccaagcatctcacccgggcagtggcctgtcctgcagccactgggcttctgttaggggacactggagcctcctcagcccccaggccagcagctccagctcctcttccagacctggggccagtgtggctttcatgagcggtcaatgtgggaggctcagagtcctcaacctcacccccgctgccactcctagggaccttgtgggcttcagcatgtttccctggaatctgggggacttgggggtagagcatgtcaagaacctcaaggtccctgccgcccagcatgggactatcttagaactgatgccaggaagaatttgctaagagaatgaagggagaagcaagtgacccctgtgggcctcccctgcatcggggactggaccagggcccactgggagtgcatcttggtgcctgaaactgcaccaaggatgaggaggggaggaccctccccaggggacacttggggttcacctggcaggccacactcaagtccacagtcccccatggccccagcgggtggggcaggggacgcacccagctgagggaactgtggcagtcctgctgttgtctcacgtggccctagggggctcatctgtagcccccacgggagccccaagaagccaatccctgctgggctcatgggctaccacctcatacagccccatccctcgggaggccctgaggagaccctggggctgggcagggcgtgaccggccagctccatgcttcctgacaagggggcctggatgtccagggagagccaggagggaagcggagactcaagtggagagtgtgtgggagggaacgttgctgggctccacaaaggagggggcaccagggctgactcccaggttcctggtggcatgcgtggaggcaggtggggccaggagcaccagcgcagcacatcctgcgtgaccttgggccagctcctcagccctccctcgacagccgtgctggtagctggccaggcccgggtgagtgagttccccaggtaggtggaaggggcttctggggtaggggccacgcccgggggcaggtggcccaccctcccaatacccagtcccaccccgccctaccacaactgaggactctgcccaaggaccagtcagggacgaggcatcctctccaactgcactgcaaggccagcacaagtgaagggcgggacagaagcctccacacaacaaaggcagaggaccccatacttctctctgagtcagtgcagaggtcctgcggcagagctcctgctggaacccaaactgcgccgtaggctcctcactgagaactagggacttctccacatgcacccagcctcccctccggactccacagctgctagccctgcccggaccctgtgcaccccactcccaccccgtcatagcctctcagccccactgtcatttgggctcccctggcatgaactaacgtgtctctcaggatgtcctacgaggaccctcacggcagaaggaccgatggggaggagtggccccagagagcagttccttctctgtacccaccagggttcagcagaggctcctgctccaggcagtacagtggggcccacatgcccatcctcactggccacatgggctggtcagagtccagcctggatccccccagggcaggacaggacaggtaagaagggctgaaaacctgggaggcctccaggaggtgagggacctgccaccccttcccacaaggccctaaggccccaatcactagtctcgatttccacagctagtttagtccaggccaggaaagggcgtgcaaggggcctggcctggaagaaggggtccctggagccaggtgcaccaggagcctccagcttgcccaaatcaagctgccactatggccgggtcctgtgggcagtgctcactcaccaccgctccagcttcacgatagccacgtgcggacagggaggctcagagggtaggtggctccccgggggaaacagagcaacccttgtgcagccggctgggccaactgatctgcacctaacagccagtcttgaaggccaccaaccctggggtctcccggagctgacccagggacagaagggcaccaggcactgcccacaaaggtgcaactgatcctcctcaccggcgcctgggccctccctccctgccagtgtggctgtcccacccttcatggctttctgcatcctcaagctaggcctgggctcttcaagtggagaggggtaggcagacacaggtgccaggcactgggaactagggacgggggcttccctggtgaggatggaaaagaaggttcctacatgagaccctctagcccaggccctgagaacgaaggggccaaagcttcacctaggggcagccatgggggagtttaggcaggcagtgcctggctggaaacatgtcttagggaagcacttgaatcccggggtggggaacaagatggtaggcagggagccggggccggctgtggccacaggccggggacagaggccaggtctgaggatggccctcagtgaggagtaaaggggatggaccgggagacagggtgcaggtttgacactgattttgcctttggggatgggtcgagggaagaggctgagactctgggcttggacgttgggtacggaggatgtgacactagcagacaggctggatctggaggcccaaggtgtgtagtgtggggagctgtgtgtgcaggagagatgcagggcactagggagcctgaacccctgctccagtgcacaggccgggcacacggcagggaggaggcagtcaccattccctcacttgccgggacctgggaggcagggcagagtgggtgatgggccaggctggggccttggaatgacatctggcatgtggcagcggaggggggacatgtaactggggactgtggactcccagctggaatccacctccaccttccacatccacgcactgcattttggtctttactgagcacctgctgtgtgcaggggctgctctagcccctgggaccaccaagggccagccctccacaaccccagacctgcactcagcccccacccacttcctccagagccccacaccccacacactgaggactctaggcattttcccactcttgaagacactgagctgggaacaccacctctggctaccagccgtggactgcagagaggcctacggtgaccaggaagggtggagctgcccaaggtcacacagcaagccagcactgcacaagcttacccatggctgcccagccttggggaatgggggacttctggcatgtccccgagctgggccctggcagaaggcaaataaaggcaacatctcaacaaggttgtgatagccggggatccaggcaagcaagggacaatccaggaaggctcccaggaggaggtgaggggcctggagcccaccctggcctgagcccctccttggcactccagcctgcctagccctgcccccttccttgacgggcccctcacccagcctcagccttggcctgacatttcccgtgacatttgctgcaaagaaatagagtcataaatccaaaggttaaatttgcacatcgcctcaaattgctgggagaagcagtggtccctccacccactgggcgccccgtgggtgcggggtttgtgtggcagggtctacccatcccagggcccttgctggaggcccacaggtctcctcctctggtcctccggggcacttcaaccactgtttcccaaaacaggttcctgggcacaccaggccctgaggtacatcgcataggggtgcctctcagagaaggtgctgcccacccctctccaaaacagggcccaagacgccctgcgggaaaggagcaccatcagcaccatttattccagcaggtcccacatttgaccacaaagcccttatgtgatacccccaacattccaaagaatttcaactccatggaccgtgacccgtgacagccagctaagaatgccagggtgctgactggagagccaagaggcacccgggggcccagggcaggctgctctgagtgaggctgggtcagcacccgacacctcactcccagatcagcccagctccatgtgccagggccctgaatggggctttccacctgccaggcctgtgtagacctacatggggaccctggcctgtgcccactcagcccctcctaaggccactctcgaggtgtgccaactgccctgcctttcttctccacctcctggtctggctgctgtgggttgcctccatcggacaggacacagctgcggaacagtgtcagcatcaccccatgccccgctgccctgctgccccgcagaagaggccccgcaggccatagcaggcaagaccagaggctgtatgaaagaggcaggggagaggtggccccaaggcacccactgcacaaatggctgcccagactctactcactcaccatcacctacccggccagcccacggttgtcaaagcctcagtgggctaggaggggcaggatctggccctgctgccgagtcccctgaaatcagcccaagcatcgggggagaggcacgtgaccagaccccagacctggtgggtgccagctgaggacatggtggggtgggtgtgcagagctgcatctcccagtgtccagctccacggctgcaggcagtgcaggaggccggtgcaggtttggataaataaatgatggtgcattctcaggaagggattccacacacaccagaaaacccatgatgcacaagaatagttcccgatgtgcaaaatgtttaaaatacagcgataaaagaagaaacggcagcacagaacacctggtgtgggggagcccagctgggccccagggacagtgcagggagatttgtggggtggggcagcatgcccgccgctccgatcgggcttccctgggccactctgtgacctcctatcctttaaagcatttaatcctagagatgcccgatgccaaggatcacaccccttgatttgcctggctcagaagagaatctgacaggctaggaacgaacgagtgaatgaatgaacaaatgagaaagtgaatggatggttggggcaaatgcagcatctgggatctggctttgaggagggtgcctgtgaccttggcctgggtgcagccagaccgcagagcagggacactgaggggtgcagagagggacccgagagggcatctgcacagctgcagaggcagcaggcggccaagccagctcccgcagaccctgaggcccaggccctgggtggctgcagagggtcaggcagaccagcctgggggtcagaggtcaggctcaccagaatgggggcgggacggcatgaacctcattgatcagatagtagccaagtgtcaggagccctcactaaccctgtgccagggccgggcggggcgcctggctcacacacgcatttgttcatttccaggtcatcctgaaactccccgtgtgcttcctgctcttgacccctttcccaggtgcacagaccaaggctcccggtgagaggttccgggccacaggcccaggacagcaggagggctcctctgcctcccgcccgtcctgtcctcaccagctggaccctcctggtgttgcaccggctgcacagggccgtccgtgccacaaagcatgaattcaaggctggggcagggacgaggagagggcaatgctacaaggctgcactgttcctgggcagagggagggggagagcacggtcccacacaccctggccctcacagcctgcctgtcactcacagcaacagcaaacaaaccctggcccctccacaggctgtgggccagttcccagcctcccaggacagcaggaccttcccccaccttccagggccccagcccctgtaggggtgtcctccatggaccctccacaagccctctggctttcagagacgtgctgggccaggccctccctcagcctctcccctgcttctcactccatgcaaacctacgtttctgccagtcccagcagaaggaccctggcacggggaaactgaggctcaggggttccacagacccccaggtgaggaacagggggagggcagggagggagtgaaggtactatgggagggtctcccaagctgggcagcatccctgccctgtcccctctccactcacctgtggcccgagttgcctgactaggggcttttattgtcccttctgcacatggatggggtgaggggccagctggcagtgcaaaggtcccaggaggactctgctgagtgggggtgtggggaggtgttgtgggcattctgaggcagaagcaccagagtcagaactccacagggaaagccgggccaattccgcccagcctcagcctggaagtgccccgataatccctgaccactggcccatggtgcaggtgaggaagactgaggcagagaggcgacctgtcacacccaaggtcacaccgccagcaggtggctgagccaggacccaaatccaggtcacggttctgccacggcaggccctgcacgtgcccctctgccaggtggcgtctaggtgctgatggccacccattcccacccccggcatgggagctcacttcctcctcacctcagtagagaagaacagggaacagtaccccctttatagatgggaagactgaggcttagaaaaagagactggccagccccactgcttcagctgcccctctgctagtatgtttcaccctcacacaacctacaaggataacctgctggtccccactctatagatgagcctctggtggtggccaggggagcaggaggtgtggcctgccaatccaagccccagcccagggcccttgccacagtgctagtgggccacccttgcccatcatgcagcatggcatccatctgctcagcaccctacacaacaccggaggtaggggagcccaccacagaacccctcaccaagaaggtcctcaccatggagaaactgaggcactggaggcggggcctctgcagtcacgctgggtcacgtgctccagtcagccaagctgcagcggccaccaagggtgcccagggtctggcctgttggtcacagtgttgacctcatggcctgaaatgggtcttccctgcccagacaggttccagcccaccatcatctatctgcctcagccctggtgggtagggagtggctgggagaccctgcccctcacaccctgggctttgcggtattcaacgagcccccaacacacattccagggcctctgctccagattaggccacagcctgtctaggcacacaaggggcacccacaccctggaggcaaagagacatgcctatgtgcccgcaggcacacatgatcacgcgcacagacacacgtgcagatgcataccaagttacacacacgcacacaagcccgaggcggggacccccaggacacggaggcaggcaggcagaggtggggcccaggatgtcttgcccctgtctgtgggcctggcctccccactcaacagacgagcatgtgggtgcgggagtggttattgcgaaaggggccccagcatgtgccacccgtggagaccacagcaggcatgccgcgtgcatgcatgtgtggccgtgggtgtgcaggcgggggcgaggacacagatatgcaccctcagagtccgtgtgtgcacccagtgtttgtgcatgtgcacactggggcggcgttggcttgcatgtgcaccagaggtgtgcaagtgtgcagtccgtgtagacaagtgcacgtgcaaggaaacgtgtgtgcagcctgcggcaccatggacatcagcagggcagcctgggtgggcacctggggagcaccctccaggcggggcatgcccaactcacatggagcccaccctcccttgcccgcaccgcgggacctcacagccggtggggcgggggagtcccacgagggctgctagggaggggttgctgattgccccaccgcccctgattcccccagccaagcctctcaatgtccctcgggctgcagatggtgggcgttgctgcctcctctcaccgcccgccctggaggcagcgctgggacaaccctgtcccccacgccctctactgccgccaacgcccccattcatcccactgtggactgacctcggagaaacgggaggttctgagcccagaccgtgaggctggggtggaggcggcccgacacccccacccaccctcggtacccacgtttctgcaaaaacccgctcgttaaccccttggtggccggggcgctccgaggccgggccccgcccttccagcccacggcccccgccctcgacttggcccagcatcggggaccctcggaccgccaccctcggccctgccgaagccgtcaactttcccgggaagcggcaacttttcctgccgcctccggctccgccctcccggggccggggcgccagcggccccagcctggcgcggcactgcggtggctttccctgccgcccggctacgcttccctcgcctcggcagcccgggacgggccctgcggctccggggagggggcgagccgcccccctccgcgccccgccgccggccgggctcgggtgcagcgcggacactcacctccagcggacgccctcttcatcgtaggggttgggcggggcgcgtcggggactgaaagtcgtttcggggcgggcgcccgtctccccgcggccgggtccgcatccaggcgccgccgctacggcccggccccggcccggccgcgggacgaggctcggcgcgctccgctccgcccggctctggctgggctcgggccgcgggtgcgcagggcgcgcagggcgcacagggcgagggcggcggcggcgcgggggttggggcgtgggcggcgcggcgggccggggcgcgcaggccgggccgcaggaggcgctcagcccgcccggtgcaccggcgccgcgcggtcccagacaaaggcggcgcattcctgaagaggcggcggcccctgcaggcggcggaggggatggcggcccgggccggagccggccggggacgcgggcccgagggtgtggcggcctaggctggcccggtccccaagcgggcaagggctttgtcccgaggcctaggaatggcctctgcctgacccactcccttcctggcctcacgaaacccatgaatcccccgccccctgcacagaagccccttgctgcagcacgatcgcccccatttttcagtaagaaacaggctcagggcttaagagagttctgggggccctcctgggcctttgtggccctctctgcaccatcctagagaagggacctaggcctgatgttacccgtaaccctgcaggggtcccccacctcttcccttctgcggaatgggggctccaaacccagaagacgctctccgaggtcacctgcttagtatccccccactctaccaagccagccccccacgggcggtgtgaggcatggggccagagaatccagtgacgcccctgcacacaccacacaggggtgcaggtgtcccttctcaatcttctgctcggggcacctaccgggcctcaccgatgagctcctaagtgcatcccggggtcttcagacaactgccaggctgcccctgcacctggagaagtgctgggagtcagctcagccgggctgggtcctccccaggcccaccctgcatgagaggaccatgcagatgagggtcttgcaggcccacctggtgtcagtctgtaggaccctgactcaaggacggagtgggccagcctgatgccttgatggcccccctcagagcccaggtccactgatatgaagcagagagacctggtgactgggcacccctgtgccctctgcctgcccctggccatggaggtggccctgagggagatgagcagggcgcagggccggtgacctgcctgccttgtgcagaggaagtgaggacctcccagagccctggtgctcccatctgatcccagtggcaggcagcttcgcagggtggagccatgctgggtgggccctctgcctggtgtggaggctgcactgcccacatgcctctggctgccgctctgtggccctcatcactttggcctgctttatccctatcacccttgtcccagcctaggcttatgagggcattgtggagtgcatgccattcccagccacacagaaggtgaggtggggcccagacacccccagccactctgtcccctggcctcctgaaggggtgggctgtgcacacactgccacctccccagagggtgctggctgccgagtgccaccagctcagcccctgaggtggctcaacaggtcctcccagagccacaccaagacgtcatcacccattgcacagatagggaacctcaggcgaagctcacagagccagtgggaggctgaggcctgacccccagacaagcattcttctccagggtccctgcacacagcagcccccaggctaggaactgagctctctccacagggatgtatcagaccctagatgagtcacgtggcactgaccatcagtctgaggacagcgctggggtggaccaggctccagtctcgggctgctctgtgcttgcagaaaggccttgagaggacacttgcttgcttactccgcaggcgtctcttcaattaccagtgacccagagcagcccactatagctgaagattgtgaccccacaccctatctcataggtttaaagcccctcccacccctcctgccgcagccgaagtgaccattctggggcatgggatgggcatggggtgaaatggggagcaggggtggccctggaggcttctggcaccagcaccctctccagccaccaacctggctgttcccggttgctctgcgctgggacctgggcctccacctccccacaggtctctgcatgggagcagggctgaggcctgcagagggagcgctgggggatgggctggtttcctgtgtccgccacctcggtcagcacgttggccagcaccctccccactggaagctgggcccactcctgggtgctagctgggatggttaggcgtcggccagcgctgatagggagttatgggggtgcagaggcagagttgagcagggctaggcagccggtgggtctgctaccagcaaggcacagcccacttctcaggctgcgcatgtgggagggtttggtaagccacatttttcagggtgtagccgggtgaggggtagcatggggagtggtgtactctttgggcaggcgaccacggagccatcaccccccagggcccaacgggcaagaaggggagcagctgacggctggtgaggggctagcagggagggcttgacaagggctggagcccctggtcaaggggcacaaccagttctatcgggtcaccttgtgggaggagccagggaccctgtgggcagagcctggccgtctgctgcccggagtctacaccagtcagttcctaggaagccccatcaggggtgctgggaggacaggccatctgtgcccagctgatgcaagctcccaggctttctggacacgtggccctggggatcaggagtgagctggagactgcagacagctgtgccctcagggccacacagacctgtcacaccctgcctggactgggtcagcagggccacacgggcatctgcccgaatcgttccccacctcacacccaccatgtggggcacattctttgccagcttccccagcccaccacccctctacagtgaggccaggggctgtctcacctcccacccacacccacacccaaaatgtggggctcagcctccacgaccagcatgccggtcatgagggccctgcccagctgtgtgacctcagcccagtcccttggcctcgctgagcttgcacagcatgtggacgaggcagacgctaatgcctcaggtcctggtcagctggtcaccatccctcctttgttcacctcgcctgtcccctgagaggatcatgcagggttttcactcaaaactccaggactgcccatagaagccagcttgagatgaggggaactttcgcggtggcctgtcttgggctgacagggacacggttcagcctccttggaaggtcactgcttcccagggcttgggaagactcatctcctgcctggagagataggcgtgccatggctttccttggcatgcctgtgcggtactcacggacatccaggccctcagtgtctcctggggagggatggggcagcaaggaaactgggtctttgctccacacattctgggccactccaggccaatgcaaggagagaccaagaaggaagctagaaggtcatgtggcaagcacatgcctgctgcccaagtgtgtcaatgtgactgaccttccctgcactctgagtgggcggctggggatgtggtcccagtgccagggagctggggggtgttggcctgccatctgctctcaccatggagggcggctgcatgcccaaggcctaagaggactctgtgccaggcctgctgagtgagtcatcccattcaatcctacagtgtagacactactaccactacccattttccagaccagagaaggaggtctggggagcttaggtggacccacatcttggcagcccctttctgccctctctttgtccacagcctccgcctcctccagaagcctctcaccatcccccatccccggggctgcagagggtgtcctggccttcccctatcagctctgcacccctgaggactcccatccctaggagtccctctgcccaactttggtgcatgttaagccataattaatctgcttcctcatctcttattcatcaaagccacagcagcagcaaagggggctggcacaaggaagggaccgacaaccaaaccctggcagtggccccaagaatcccactgggcctgcccatctccaaatgcctctgacccttcactagcgagggcctcctcccacagaatggcatcctggattgtgccacactaggcaggccccctgacggaccatgcgcacctcccaccacctggaggctgctggggaccgtcaatgggacgtatgcattgcacagtgatggcccttacctctgcgtcccccagccctggactggatcccttgtggcccatctccaggatgggagcctgaacggagatgaaaggacactcggccaagtgggacatgccaggctggcacctggaccctggtccgccactcttcctggtgcctagaggaaggggtgagtccccagggctcctggaccttgagatgagcctcgggccacttgtgtttgccagcagatgggctcagggtcttctctcagtgggcacaaccgagttggtggcctctctctggggaggccggctggtgggggctggggagtaggcggcttctggtccctgaaggcccaaatctggtgcaggggcagagctccggaaggcgggggtccctgggctgtgcccaaggcatccgctgtggcttcacgcccctcccccgcccctgcagggagtgtggatccttctagagccacccacctggcagtgacagctaaattgggagccgctgttcacaccaggagcccagcgggcagtcaaaaccgggtcgggggggaggggcacccgctgaaaacacccacaagctcccagtggggcagggaaggcagggaaggcatggtgatagctgtcagcaggagtgggtggggagtggaaggcagggtagaccgccaaacccatcttggggccatagtgagatggcccctgggatgcttcggctggccagtgcccagccttgctcttgtaggagctccctgggcccctgggttccccactctgggccaccacaatccatgcagcatgcaggtttgttccgtttcccagatggagaggctgagggcttaccacagggttccgtcaaggacgcaaaagggccagcctgactctgagctcagtagccccaccctccacagcctcccttgccgccttcatctgctcacttcctcagtcactcaacaaacactctgggaggcagactgtaacaccctgcatacctctgctggacccccattccacatatccccactggttacaggtggggaaactgagtgcctgggaggcgggccttggcctgagtcccccagtcagtgattccaggataaagggcatagccatgccatttggtcacttgaagcccacaggggtgactgggaagagcccacctagcaccccacattctgctagggtgactcagaccaagtccttggggctctgccccccagccagtggctctgcctctgagagccatgggacagggagctgtgcagggtggggccagcagagcctgtgcccctgcctgagctagtcgtgatggggcctgccctgaccccttcccaggctcatgggtgcggagcagggcggggccttacagtgagatgggggcctctgtgggcagtcctggaggccaggccctggggctgggactcactggcacagggcctaagtttcctcctgtgtccgcaggccttattgcctgcaagggaggtggaggggcacaggggcggtgcccagcgtgaggagggggctctgaggaggctgcagcagccggcaggcctctgagactgggatatttttagccaggattcctgctgacggtccaggctggccggggtttgctgccagccttagaggcgcttctcctagtctgtgtccggacatctggggtctgctggccccacccaccctctgctcaatgcccccgccccactggcccatccagccaggcgaggggctcccaggaggccggccatggtgggagcagagcctggggccctcggggtgtggctgagaagaggccacatgggctgctgggggctgcctgtgtcctgggtctccagctcccagctgccactcttagccgacccgcttaaggggcaggtttctggaggctccggttcatgcccaggctcgagttctgaactgagcattctcagtccgctgcctgctgcctgctggaacggatggctcagcagagcggccacagcttggctccctcctgggcactcctgcctgcccttgccgcttaggtgctctggtcatcaggcctctctggctggctctaccaaggtgcatgtgtgcagggcctgggcttgcagggccttgtggctcagccaggaccacctcccttcccatgggcaagtgaggacatccagaaagagggtcctctgcctcggccactcccttgggacacccctccaccccaaggcctctcgtggaaacagagtccagcactcagcgtcatgcctatgcactccaccggcaggactggctgagtcccgaggagccaggccctggggcacaggccaatcggatggaacccagatgaaagcccagtgctgggacccacggcccattctctggcctggctgaagcctgatggcttgttccttgaatgaatcaggaggcccatccagagcaattgtgaagttcacatgaaagaatgaacgtacggagagagatgggccatgtcgcatcctgaaacgccttatattctaagaccatgataattaacacagaccctggacagtcacacgatgggaaagagtccagaaagaggctcaaatgcaaatatgagaagaggcaggtcaaatccaagaggagagatggaatattcaacaaataatcccacatatacaatcaacacttggccttaagacaacggaattgacatatggaggaaacatttggattcctacctcactccttgacgctaaaacaagttccaagtggaactaagatttaaaaagtaaaaatgaaaccataaaactcctagaagaaagcatggatggcaaaaaaccaatcttgagtcactctaagaattatacaaaacccagaagccatgaagtaaaagatgggtatattcaacctcgtgaaaataaaaggcagatgcatggagagaaaaaaaccaccataaaatgataaccaacaaagggtaaaaacatcggcaactcagttcacaaagggccgtttttggttctcaatacaaatcagtaagaaaaagagcaacagcccaagagaaaaatgggcaaaggcatgaaaggaacctcccatcaccccctgctgaccttcactcagagtgagaaacatgcggatctaagctgcagtgagatgctgcccctcacccacagggatggcagccgcatcaggctgggggttccctaggggggctgcttaggggctcccacaggtctggctgttggagggcagggagaggcctgcgggtctggtggggccggggtgaggcactcacagatatgtctagtgggggtgaggagggggaccgcctgcaggtacagctgggggtgtcaggtcgctggggatggggtggaaggagaggatacccattcaaaacaggaaatatatatattttaaagtaaaacaggctaagtgcagtgactcacacctgtgatcccagcagagcggggagaatcccttgaggctagaagttcgggactagcctggggaacatagtgagtcccagtctctataaaaattaaaaaataaaattatctggctgttacgatgcacgcctgtagtctccgctacttgggagctgaggcgggaggatcacgttagcccaggagttcgaggctgcagtgagccatgattgtgccactgcacttcagcctgggcaacagagcaagaccctctagaaaaataattaaaaaaaaataaaaataaatataaaataaaataaaaaccagctgacatccatcctctccttgccaccactgacatggccgtgggccgagttctcatggccatcccaccgcgagtccccaagcgctcctgatgcctgctcacccttcttgtctttgttagcgccccgttagcagaggcctgcttaacttgtctctggtcttgcttctcaggagccgtgtcacattcaacagtggcagcacagaggccctgctcagccccagtccctcaccctaggcctccactgccagatgtggtcctggtggtcctgcggactcaagctgtccccccctgcccaaccttcacaggccaccagcaagtcccaggcctcccacaggcatggctctgggcagtatctttaccttcccagcctcagtttccctgatggtgaaacagggtgagatctacttcctagcagagaatccgggggaatggaggccgtgggaggaagaggacttgaggaaaggagcattcctgaggggtcccagagcgggctggggctgacaggactgagtttgcagggcctggggacattccctggggaggtgctaagatgccggtcagctagagcagcggggagtgatccaggatggctgcccggatgaggggctgggtcgctggtccctgagtgccaaggtggtctgtccatgtctgcaggaacacacccaccctgctgcctccaggaggggtgctggacaggcctgagctccaggatcataggaggcaagagccactctcaccaaagaacagcaagtgtgcctcccctgccagcaatctgtccggtccagcccctgcccagctatctggggaaaaggccaccttttcagtggaggctgagctcagggcaggaagaggttgagaggggagaaatggagtgagaactggaaggtgagaggtgtgagtgagaggtaggggtgtgaattgggggtgagatgtggtaggtgagagcggcaggtgagaggtagggatgagaggtgggggtgagaagtggaggtgggcagtcatggtgatagcttgtggggtgagaagtggagggtgagaattggggtgggagttggggtgtcacctcccaaaccctctcaccctcagattaagaagcccctcctatgggccctggaggaacaggcctttgacccaccccaaccccactggtgtcttgggcagggagatctcgaggtgggggcctcagctccccgtaggaccgtctagccctggaccacctgaccacagctacagtgggacaaggcccctgttgcctgtctgctgggggccgagcgtggtatggaggagccagcagcccccgccttcatcacagaggaggaatccgaggcccaggagggtgtctctggcacccaacacgtgagaccctttgaaaatcccccgagtgtgtggggggctgggatgaacatctgggggcggcagcagcaggtggcccacctggccaaacacactcctgtgtccccttgtttttggcaatttcaatgaccaaaatcagatcctggtatggagaaaaagacatcggtaaggacgaaggaaatgtgaacactgcatggacgatggctgataatagtgtgccgctattggctcagcaactctaacctaccaatgccagatgctcacaacggtgaaactggtgtgtggtagatgcgatctctctgtactgtcttctcaatttttcagcaaagataaaactgttctaaagttgaaaagtttattaaaaaaaaaaaaagaaaaaagacgggcttattagcaaaaatctgagatagaaccaagcagtagggcccagcccaccccccgctcagggcgcaccagcagtacccctctctcagggacatggccaggcctgggccactccgaagagctcttcctggtgctggggggcctggtgggtttattccacctgtcagtctcactgcaaagtgtggcagtggagtctgagttaggctgactcttaccctgccaaggacacccctgcactcaggacccagccccggcccccttgccctgtgggctggaggcgaccctgtgtgcagatggcagatggaggggcatggtgctgttgctctcaggtcaggggcagcagcctcagccctgaccagccctctcctgcgtggttgtggttgggtctcctggtctctggcctcctttccattccaacctgtagaaaacagtgtggtgggggatgctcggcctgcagatcagacaggccggggtcaaagccccgaactaccacctgaactagtcctggccgagtggcgctgatgctctaggccgagggcccccttgacagaacagccatcatctagctccgccgcagggtaggggaggtggcagtgtgggccgcagccctcggctgaagcgggggccaagcggggctctgcctggtgcagggggtttcctctatggggcaggggctcccaaattagccctggtgacatctggagctcacctctgggggctctgggggctgagagagcaggcggggcccagttctatcaatcatctgccttgttcctgggggatcgcggtcagtcccagcctccccacaagtcctggggcggggcaggcctgctggaaacccaagatgcagagaagagcgccaagcacctgagacagggctctgagcacggaaggcaaggacgcctccctcagcctcagctggggagccagtggccctgcatgcactttctcccgtctggggagcctgagccctgacccagtcccgaggcccatgtgtgcacaaaagccccctgctttctcacccaggacactggcgatcagtgggtaggcgagccggagcccagctgctgcgctcccttccctgccaggaccgggccagctgcatcctcatgcctgggtttcagggcttctcgggggatgtgatggcactgcctgaggatgtgggatccttccactgaaaagggccacacggctgtccccagcacccttccagaagggacaacccactcctgggaggtcttaatgtagacatcgaggtcccccgagcttcctccatggcctggccacttcacaaccatatttctttatgttccacgcgccttgcctgctccacggccaggaccagggccaccatctttgcagccggtgaagggacagctgccgtgggctgggctgctgaggcaggacaggggtccgggccagggaggggtggatggaggccaaggatgggccccttggagacagccttggggtgcagccggctctgccacctctccctggcttccttccctccaacctgtgactcctgggaagtccctgatgggccagccacttggggccgggaagtaactgtggtgtgtggtggtcaccctcaccagagttcatggggtggagcaagggggaagaatctcccccaaaatcaggtgtcttgttcccaggcccagcacagagacctggcccccagacatctctggacatttgttaagagtggacaactgcttccattacacaggagaggaaaccgaggctctaaggggtcccagacttgcctggctgccacagtgagcaggcaacaaataccaagtggctgccgcaatggggtaggtgggaggcagtggctgaaccagaaagtgctgctgtcgattctgctggttgcatgagtcttaggagatcatcaaagggcagattgtggggagataaaaagtatgagtggggaacaggattggggggagcagaagagcctcaaagaccctgcgacattctcaacgtctcgatggtgactcagagatagctccaacccgcatggcgggcagagtgcggaggggacggctttgtggctggattagtcatcccggtgcagctcaccccaaatcccggcttccagccctgggccgtccatgctgggatggaggaagggcagcctctccgcagggccacgtcctggagcctgataacctggccagcacactgtgcaaatggtgcatgagacagggagttggctctgtgttccccacggtggccaagggaccagctgtgcctcagtttcccttattctatcaaactttgaagaaggtcccgtaaaagcgcatctgtttccagggtaggggccagagtcagccacccacaccagagtgagaattggtgggtgccctagccctggcaggatctggcattttgctggacggagagaggaggcagcacccactggggctcgggcaaccatcccggctacccccgccccggcccgccaggagaggagggaagccttgaagtgccaggcctttgaatcgcccatctccatggcaacgcgtgggcacaaagggccgggccggcgagcaggcggcggctgcgcaagctggaaggaggaagggaatcttttatttatggggagggagagtcggggagccaggctgcgcccacgctcagggccaggccgcagtcttgaggctgggccccctgccccatagccagggcctctgagcagcacctgcccacacacccctgaccctccgtgcctggctgggtggacggagcatgggcaaatggagggcagaatggagtgagtgtccagcatgcacccaacctggagatcggcccagagggtccctgggagcctgccatcctccataccccagtctctgtgatgcgggcacccgggcagataccatgctgagagccagctgggcctgcagtgaggaaacgtagcccaaagcagactgcagagctggaactcaggtggggctgctgccataggctctgaagacagcgcaggagaccgggaggggtcaccagtgccaaggccctgaggcaagccagagctgggagcatctgaggatgggcattagcgtggggctccagggtacagccggtccactgcaggcagcctggcctccccagagacccagccacggctcctcaccttggacagggggccctgggccttgggcatcaaatgacctgcttgccgcggtggaggctgccataccaggacgccggcccacggcctccagcggcccgtccccaccttcccaagcccctcccctcatggctcacaccctgttccctgagcccccaaacatgggaaatggcacctgttgtgccccagcgggggaattctgaccccagaccctggggccagtgcagaaaccaccactgtatcagattttatttcatctaaaaaatatctgagccagattgaaagcagcggggaaagggtcccatggctgcttcccccagccccaccctccacaggccctgggccctcccagcccccatttcctttccttgagaaagtctaaagtggggcaatattttgtgaaattggaggcaccacgttggaaattccaaacccgtgtgtacgatgagctgcacgcgcgttttgaacctgccctggttttgagctgagggaagcggagggtgcaggagttgcccactccagaggccctgggtgtgcatgaggagccctgaggctgggccgagagccgcttgtgggaggcactgtgccccctgcccccgagatcagggcctgggtgcccaggacactacagaccttttggggatcctgggggttgggaagcctagagctggaacccacaggccagagtctgagctttcatcccccacccccgaagacgctcccccagccactgcctgcgcatcgggggagacaagctccccccacgcccaccttgcctccagcagggctgttcctcccctcatctgctggcatcagttttttctttaactgagccccatgctggggaagggagagctccaggggaccaggcagcagagaggggaggagagaagccatcaaacaggccgggggctgggaggccatgcactcagcatagagccccacatggcagcagggggctggatggccggcttagagcccattctctcctggacactgttctggaatggcccctggcccctccgttccaaagatgggaccctccggtccccggggacccgggatgatgtcccccaaaccacctctcttcccagacttcatcaatggcaatgaatggtgcatcctggctggggccgccgcccctcactgtgagacttcagcccagacgagcgcccagcccctcctggggtctcagatagtcagaaagaaaggctcacggctgccatgcacttccacaggactttgtggttcctcctgcacccccggtgatgctttcatccctctccagcaccattccagaggccagaaaaccatgatgtttggggtcaaacagctgggagaggcagttggaactcaggccaggcctgtctgactggacagtgcagagactgggaccatgctcccctacaagtgctgtcagtgcaccctcgatgccccccagagcttgccatgccccgacagtcccttcatggccaaagtgttccctggcacaggataccctggggtgccatgtctgcaagagctcacacccttctctccccagctgctgctaactgctgccagaggtgggagtgtggagggctcggggcctcttcaccctccctgcaccaactcagctccagaacattcccagcagtgagaagagggtggccactgtgctgcagccccaagggatgggcaaggccatgccagctggagtcatccatgtccccttggacatggtggcctcattcagagggcagcatggaggaaggtgcaatgagggtggctaccagagacagtggagatgaggcagtcaggaagcccagggacaggactggaggggacacacggccagcctgggacagggcatgaggcctttgttctgcgtgctgtggcatacggtgttggctctggccctggcccatcttttgttagtggtaggagggtgctcctttaatcagccaactctttgtttcaaattgcccctgtccttgaaaacactgcttcagggaagcgtgagacaaagccagttcagtggggtgcctacctggccagcagccctcatccgcaggggctgctcctggggcacgtgccagaatcagacagtcccaccgtcatgcaggtgctggggccttcagtcagcaggaccaggcagcccatgtcctggggacccttggggaggtgtgggcatttgctgagttgggctgtcatttgctagacaggcgcttggcgaaggggcccttttgtgcatggatgccctgggcaggtgtcagtcctgagtcctggagaggaaggcaagctttggagttgatgctgggtcctaggagggagcgtgtggtttcgccagcttctcaaaagtcacctgagaccctgccaagggacctccagacattcggtgcaggctcctggaggctggacagagggcaccaaagggcgacgggccccgaggacagaggtgtgcagccaggtggggccatggccaggctgggacctgctggagctcttgtgtgtgagcctggaggagctgccaggctgggggagatcggggctggggctgggggcggggctgggcgtcagcagggtctgcagctcccatcttcccagcttatagacctgaatatccaggttgagaataaaccattctcccagggcaccatagcctccaggaagcacctcctccttccaccatccgcctttcaggaggggcctccctggggggctgtctctgggactgcagaggctgcttggtgtatctggggctctgacatgagtgagattgttccggggcctgtgctgcccagcctcttccccaacagcttcctctggaggcaaggggcttggcaggagctgcagggagccaattatccctgaggcaagctggctgcagataattgggaagacaggcttttcaccagcagccaagctctggggcgcactcgccacaccaggacttgggacttgaggatccagaggtctgccaaaccccacgcctgattgggagccccatgtgctgccatctaccaggggaggtggcattttcttggcaactgaggggggaagccaggtgctgaggtgtggcccacgggacgcctcgcctggggacctcccagcccttctcctctgcctcctaggggcctcctctccttacacatgaaaacctccaatgtctagcccagggctccagattaggggtcagtgccgcccccagcccaacttcctctgggaagtgtggggttctccccggggcactcaggcctctttcttacagggcttcccaaggggaggcatccagaggaaggcaaaggctgtgatcaggtagaacccgctggacgcccccaccatctccctccatcaacatcaaaagacaagctgaccacccccaatgcaaggtggacattagggttaaaccctgagtgaccagcactcagctcccagcctggccgggatgcagtggggtggggtgtggtgggctcatggggctggtgagagcccggtggggtgggtttcaggtgctgcttgtccagggctcagctctgttccttggggctccctcagcccaagggcccacctcccctctgggcagccccgatcggcgtgttctgcctcggccagctgtcagccacctgcagctcctccctcattgcaccaccctggagcatcacggtgcccagggcaggccgtggagacctggctagcccatggtctgctcagtcctcaccagctgttgtgacagaaacaagtctgtgctgatgagctgagccgaccaggctgcagccctcacttcaggagagggtcaggcccagccaggcctggtgagcaggtgtggggaaggatgggtgctcatgtgcgggaagtttctcaagagtggtggaaggaggatagacaacgagggcccagtggatagggcggggaggcaggaagaggggacagagaggggaccagtgaaggagagtggagggtactgcccccctgggggaaggatggggtggggctggtgttagctgggttgggtgtgtgggtctggcagggagccgggcatgggagtgggtcccgaggaatgctaggttggagccaggaccatgggcctcaccagtcatagaagcctcacctcagggcagagggggctgacagactgggctgacgggaaggggggcttcctgtcaccagagaacataaagggaccactagtggcctgggccatgaggctctgtggccctcaaggtgctgagctcaaggtgggcccagcccatggctgcctttgtggggaccccacaaggagatgctggcctctgaggatgctcagacctggttcagcatggccaggccctggcctagcccaaggtcagcactggccactaccctgggggctgagtctccgtctcgccctgtgacatggtgcccacactatgagccagtgtcaaccctttgcccatacaccgggagccttgtgtgtccatactcatggctgagggcctgtttgggggtctctgtgttgggggaggtgggtccagggtgcgtggcccctgggattgttcatcatgagtgccacctggaaggtgctggagcctcacccgtcctccagagtgttttggggagatcctgtgctggcatcttggctgggccaggatggtgtctaggagggacccttgggagggaagcaggggcatcagggggcctggtgctggggtgggtggcaggagaggcctggagggcggcggcccaagccagtggctgggcaggtgtcaggagggagaggggtgaggcctggcctccctgccacagcttagccagggcctggggtgtcttggggtgggacaaggcccagggcagaggcagggctgcttgcatgcagggtggccacatcccggcctggtgagtgccggccactcagttctgtggccctctgctgccctctgccggccgcctctgtccctgcaggcccagccatctacctgcaggtctggacagaccctcagagcctaggctgggaggtctcaggagtcaagacagggttgaatcccatttgagggcatctgaaggagtgagagcctatgtcaatcccctgcccagccttgcctcggccagtggctcccaggggactctggtgggcagtggctaaagatgacagaggggctcagagaggctgagctgctctgtaaggttgcacagtgagcaggggccgagtggccttgggagaggcaacagcaggagggtcctcgtcatggccacagcccagggacaggaaacccctgctgggttcccccaccaagtagctcccattcccagcccttagggtgtctcaggagaggttccgggggaggtcccacctgcctcctgccttctcccccaaccacaccctaaatgggtcccagctccccagcccctcccacaagggctcacccgccagagctcggggagaggccctgcagggcggctgttcctccgtgtgctgcagtcctctggacactgaaagccaatcccatccatcttaatggcatttaatatgcacagtgaaagtcagcagccacagccacgggcgtgtgctcagggcaaggtttacacgcggatgccaccaggcttagcccatgagtggcctcctgggtcccaggagacctgtggggtgggggtgcagctgggtgggccatggtagcagagacctggggaggggatgtgggaggtaggaactgggctaggcagggactcaggggaggctgaggcctggaacagggagactgagacctcaaggaggctgggacattgggagtcaagacttggggaagctggaacatgggcaggccgagacgcaggggtttaagaatgagggtctggtgcagacctgagttggagcccagccgctgctggccccacgtagctggagagtgtgctgaccccatggtggctagagaatgtgctgttggtagggaaggcaagtgctgggaagggaaaagtgtggtccatttaaatgatacggaagcaggggagggaagtgctgggtagaggagggcatggtcccagactagggctccaaccccacggacctaggtgagaacaggcacttcctacccaaatgttgcatttctcacgaccaccctagcctgccacgcccccatcctgtgcttataaaatcccccgagaccttagcaggcagacacaggcagctggacgtggagaggaacacatcagcggagacacacacgggcggctggatgtcgagatgaacgcactgataggcaccggcatgctggcaggccactgactggcagaaccacacggagtttggctggggcagttggaggacagcccgggtgcacagcggccccactccaggggaaaaccttcccactccacccccttctagcttcccctatctgctgggagccacctcccctcaataaaaccttgcactcattctccaagtccacgtgtgatctgactcttctggtacacaaaggcaagaaccccaggatccagaaagccctctgactaacacaagccaccctacagacgacaaactaaaaaagcccccgtgacacacgcccactggggcttcagctgtaaaccttcacccctagacactgctgtggggtcggagctccacagcctgcccgtctgtaagctcccctagaggtttgggcagcagagcactgaagaagcgagccactccccttctcacacaccctgctagggcaacaagggaactttttccgtttcactggcccaaggtggctggacagtgtgctggccccacggtagctggagagtgtgtcgcgctccctggctttcctcctgatgtataaaatgagttagcgggtcctgggggctgttcccacagtgacgtggtggaggctgaccctgacacccacccctgctgaatgctcagtgaatggtggttgctgtcaggaagcatcattgctgtcctccatcagtgtctgtggggctaggtgactcttggaggatgcttccagcaacgttgcactgccaagacagaggccgtccacctgcctctgggcttcctggtgtgaacagatggatggatgcgtgggcctgctgcgtgcagggagctgaggctgggtcttcacctatgggcaggaggctacacagggctctgggagagacagcactgtggctgggacagagcccatgtgatgagatgccctcggtgcccctggcctccctcctcgctcctgcccctctggaacatcacccagagccccccttgctcttttgggggatgtctgggtgtctgcggttgctgtcactcttgatcccacccacccacccctgcaggttgctggcaggacaagtgcaggagtcatctcatggctttccctgggatctctgtacccgctgagagccgggagctgcacacagcctgtccaccatcctgggaactcaccctgttgctgccgcttgtcctgggtcatcctggggctcactccttgccattcagacccctgtgaggagagcactggctgtgagttgctctgtggctagtgatggcaaggcagggcctggagtagatccatcacgaatagttcttttttttttttttttttttgagatggagtctcgctctgtcaccaggctggagtgtgcgatctcggctcactgcaacctccgactccctggttcaagcaattctcctgcctcagcctcctgagtagctgggattaaaggcacatgtccctatgcccagctaatttttgtatttttagtagagatggggtttcaccatgttggccaggacggtttcgatctcctgacctcgtgatccacctgcctcagcctcccaaagtgctgggattacaggtgtgagccacggtgcccagctgagaattcttaatgaaatgggaacatgcctcccacgaaatgcacaggggcctgcagtgatagagtggcctcaggtatgtgcacaggtgtgaacacgccttccacagagggcagtggacgtgcacatgcctcacacacactgtggcgcagggcaagtgtcccacatgtgttcatgcttgcgcacatgtcagtgggctggatgtgtgtgtgcacacctgtgtcatgcctgcagagaagacagtggagagaaatatgcccaaatctcccctctgggtccctgccctgggtgctgggatgtcagaacaggtcgatgtccttttatccttccccatatccaccacgctgtctaccaaagcacgctttagttttataatcagaaatgaaatgcaccgtttcaagaaagccatgggccagcccctctgtgccctggtgttggcgggggcagaggggtggggtgtgtagggggagattagcctcatgcagccgtggggccagggaggccaaggtcagcttgctcagcacctggaggtacagcgagtaccaacaacacagcctagcttgaccgcggaaggaaaatcaatgctgggcgcaaggactgacggcagactcactgggaacactgtccaccgacgtcagagctgctcacagggcaccgggagcttgccagcgagcttggctgcctgtgtttggaacaaccctggtgggcgagcacgggcccctcacctgactccactcagtgcccttcccagaggggagacaaaggctgtgaacagctctggaggccctccctgccagtgccccccaggcctggctaaagaaatctcaaataccccgaagggcctggctccagcggcccctgctatgggtcagcctcagggggatgctcatcttcaattgaccctgactgttccacattacaagataaactgtggggttaactcaaggcggtattactttgtaaagactgctctttatacaagagcggtggatgcaaaaacaaaaacattgccatgtaagacgggagtcctccgagtcctgtcttcctccattccgtgtccttgcaccccatccatgtgtggcctgcatggacagacagcttcacacactcagactcttccctccccacgcatcagagatgtgtgtccctgttactgacatgcagggaggggctcatcatcttgggcacaccccatggtgctctgagcccatcatcacctatggtggacgttgaaggagttcccaggttttccttttcaggagccatggctcgggccagtgcctaggaggtcagaggttgggggcccagggagaggtcactgcccaaccgtgccaccttggactcagagtgccggcccagggaaccaggcaggcccggctctgaccgtgccgctgggcgaccgctggctgagacctggggctgaaacacatcccacatcagccaaggaaacaggctctgcatgaggcctgaagcccctgaagggctctgggacaggaggagagcccaagccttcagctgtgatgtgcacagcaccgtctgtcctccacccaagggaactcaccttggtgaccctgctggaaggcacaggttgctgacattctgacccctgacattcggacctccagcagagcctgcagtttgagacctctggttcaggagctgggactgatggggcccttggggattcccgtgctgctggaggaagatgggggcatgggggtgtccacagcaaagaagtgagaagtagaggccgccagccccccgccccgacccttccctggctagagtggggcaggcttgggggtgagtctggggtgctgatttcaccctcctgggccaaagtctccccgtgactttatggactgtctccctgtgctccctgagaccctggttctccctcaccagcctgggtccttcttgtctcagctcagctgtcacctcctccgggaagcccccaagcccttgagtgggtgcccagcaggcatggtcagtgctgaggctacaagccctgccggcacccggcagggaacacaaggccaggtcaggctctggggacagtagacaagcttatccctgcacactggggactgcccacctgggggagagagctaggtcaggctggggagacgtcaggggatggccgggcacccctccctgaggagagctccacctgagcaagagtgtcaccaggcccactccagacacatgcactgcctcagacgggctggagagagggtgtggccgggccatgggatgaaccattctgggcggttgtcctggcatcaccagacatgtggctctattaagcatctcgactccacaggagcccatgtggcatgtcctctgacctcctgttcacttctgaaaggggcggccctctgagattctgcctggaacctgtcagccctcctgacaaggtctctggttcccggccatcacaggcacccagccaccctacagagaggctctgggaggctcagccttgcctggggccccaagactgatgccagctggggcatctcacagggagcacccctacctgtaaaccgcccagctcaagccctgcctcgacctctccaagtcagcagccgaccttccccagggcccctcccagcctgcagggggtctgaggctctgaggcttttctgcagcctctcagtcccccaccctgctacctgctcaggcagagagatcatggctctgggttattgtgtgcttagtgggtgctggagctcgtgctaaacaacttgggtgccccctgaatcttgacaataatctgagggggcattattattactattctcacttccccgaggaagaagtcccaaaccccgtctggcacaaagccagcgccccgagtctccctctgcagtccatgtgctcccacgtggggcatgcctgggacatcacaacatctggggtcaatgcggctgctgttgtcactgtggcattcagctttcccaaggctcacatctgctccatccagcaaaggggtcttgcaccccaagcctgcctccctcttcacacacacaatcccacttcgtcaaccacaaagatgcatgggtttacccagcctcaaccccatcggcccctccccttccagttgccggagggctcgggccccttcagctgggctcccacattcctgacccctggcctgcaggccctcaagactatgccagcccgggctcacctggtgccagacacctgcatctccctggggtgggggttgggggcagtaggctccgtggacctagcacacgtatgattcttggaaaatgtaaatgtctctgaggacagcgatcccagcttcaaatattgctgtgggctctcgggcaagtccctcctcctctctgagcttcagtttcccccgcataaaatggagcagtgatcgtagctcctgcatgggaaggttgtgaacaccatgcttgtcagcagaatataccctaattttgcaaggaaacaatatggcaggggtgggggggatctaaatacctttccttatacacgcattgaaaatgattatataaagtggtgaagtgtgattgcattcacataaacagtggcatgttctgggatctagcagacaatcttaacttcaggaaatgcaatcatattttactagctttgagaaaagtgaataaaatgtcatagctaaatagaactcaagtaggatctgtgaacggcagcatggagtggataaggggataacgtaccgatgagggaatttatatacccagcagcccaggtttggtgcaggctgataacggaaagacaaactccaaattaaatgaatgtgaatgaattcctttgcctgcggacagaccaaaaatatcggtaaaagtggctacagggcaagcagaaaaatgcaacaaattagaatgaacgcagggaaccatgtttctggcagagaaacaaatatttcagagtacaggtaagaggcacatggcaaaaaaaacaacaacctgactttgccagagctccaatgtcatgctcacggctgaggagaaacaattatctcgctgggaatgagtgcaagtgagagaacggaaggagtcctgagcacggttgactgcatgtgcccaggggcccggacaggcagcacagcggcctctctaccctcgaaggtctgtttcttgtctgcttcctccttgagagtggcaggccctggtaactggcccaacctcgggggcgcccagcagctgggtccccaccacatgcccaagtctggccctctcagatctgcctgtctcctgagctggagaacggagcccacccctccatccccgacactcatctcccatccagttgatctccctgaggacccccccaccgacaactcccacctggatcccctggccctggtggggcatcattctttcaaaataatccatgactgtgttcagtggctcacgcctgaatcccagcactttgaaaggccaaggtgggaggattgcttgagcccaggagtttcagatcagcctggggtaacacagccagaccctgtctccacaaaaaactattttttaaaaattagctgggtgcagtccagcctatagtcccagctacttgggaggctgaggcagggggatcacaagcccaggagttcaaggctacagtgagctgtgatcacatcactgcactccagcctgggcaacagagaccttgtctcttaaaaaaaaaaaaaaaaaaaaagccatcagctggctcagggtagccacctgccaagggtccccagctgagcgtaagacctgcttcctaggatttacagagctcctgtgaaactcggttgtttcattgattgtcacatggagccagtgactttcaggccagccttgttcccacaggtgggctctcccgtgggcctgggcacccagcgctaggcctgccctgctatggtctggatgtgagcagagatctctgtgatccctgtacccctcgcttctccccctgccctctctgcagccctgcccctggcagcccctgcccaccttcgcctctgtgcagggccacaggcttccttgaagcaaatgctagaactttgagctctttgctttttaaaaaaagataacagctttattgagatataattcattatactattcatttattaccttttgcattataccatgcaattttttccatttcaatggcacaatcgaatggttttttagtctatacacaaggttgagcagacatcaacactctgtagccccagagtatttccagaccccaaagaaactccgtgggccttggcagcccctcccactccccctgtcctccacctccaggcccttaccagtgccacagtcaccaggctacattatgggcttgtcttcgtgtgacttctgtctctatgggtttgcctattctgaactcttcatataaactgaaccataaaacttgtggccgtctgtgtctggcatctttctttcttttcttaaaaaaatttcacttttattttagagacagggtctccttccattgcccaggctggagtgcagtggcacgatcatagctcactgcagcctcaacctcctgggctcaagcaatcccctcacctcagcctcctgagtagctgggataacagacatagaccaccatgcctggttaattttgtatttttttatagagatgaggtcttattatgttgcccagactggtctagaactcttgggctcaagtgatcctcctgccttggcctcccaaattgctgggattacaggtgtgagccaccacacctggctatttttattttttaattgacacataataattgtacatattcgtggggtacgtagtgatgtttctatacatgcaatgtatggtgatcagatgagggtaattagcacacctatcatctcaaacatttatcatttctttgcattacgaacactcaatattctctttctagctagctgaaaatacataatttttgttttggtttggattttggtttttgttttttgtttttgagacagggcctcactctgttgcccaggctggagtgcagtagcaccatcacgactcactgtagcctctacctcccaaggctcaggtgatcctcctgcctcagcaacccgagtagctgggactacaggcatgtaccaccacacctggctaacttttgtatgttctgtagtgatgggatttgaccatgttgcctaggctggttgtgaactgctgggctcaagcaattctacccctctaggcctcccaaagtgctgggattacaggcgtgagccgtgacacctgacccataatatgttgttgttaactagagtcatcctacattggtgtagaacactagaacttattcctgccatgtagctataattttgtatccttcaacacatctctccctccctctccctcccttctttccacccttcccagcctctactatcctctgttctacttttgacttctatgaggccagctttttttagcttccgcatatgagcaagaacatgcggtgtttaactttctgttctgtctcatttcacttaacataagtttctccagttccatgcatgtgactggcttcttcgattttgcatactttcaaagttcatccatgtcatggcatgcattagtacttcattcctttttatagcttaatagtattccactgtatggatggatcacgttttgtttgcaccgttttgctgttgtgaatagtgctactgtgcaccagggttgtattcctctgtgtgccactgggttgagggttgggggatggtaggtgctcccataaagggggaaattgactgatactggctgaaatggaccaggctcttcattaagctggcctctgaatgttgcaaaagcattctgttggtttccaggatcactgcttaagacggttcctttcagtaccactgttgtccaggggagggatgggttcccggagcttcctgatctgccaccttctctgatgtcaccctcagaccctctgcttttgagccccaggctacagagtaaaagtctgatggtaggatgtgaggtgagggaccttccttgacccggcacccacatgaggcaggactgagaacaccctgaggactgcccgggtggctggggtgctgaagccaggcttggcccctccacaggccatgcatgacaaggaccaccctgtctctgagctttgccttggccttgccgtgacattttcaggtgtgtttcagcttagattctgctctggggtttcccgtgtaagaacagggatgacgtctaagcccttgtctggcatttgtcaggaatattgggagaggcaatgtggcagtgtgagaaacaagctcacccatccaaacctgaagaatggactcagaggcacgagcagtgaaagtgagacttttttttttttttttttgagacggagtctcgctctgtcgcccaggctggagtgcagaggcgccatctcggctcactgcaagctccgcctcccgggttcacgccattctcctgcctcagcctcccgagtagctgggactacaggtgcccaccaccacacctggctaattttttgtatttttagtagagacggggtttcaccgtgttagccaggatggtctggatctcctgacctggtgatccgcccgcctccgcctcccaaagtgctgggattacaggcgtgagccaccatgcccgggaaagtgagacttttaatagtggtcttgcgagattggtgtctggtggataggcgcactcagggcagtcacagcaagtaacttatgccctagcacacaagtccctcctcctcattggtcgagtactatggggttacaatcttccaggacattgcctaagtttcattatccaccttataaggttataccccgtcgccttccccgcttaagtttcaattttccaataacgaaactttcttcccttttatgggctgaccctttttctacattctgtctgcttattgtgatcttctacgtgcatgagccgtgcggtttgttacattctcaggctggctgccagtacttagatttatcatgccttgaaaatgggccatttaaaatgttttctcatggcggtaaatcggtgagctgactgtcatacactcagtcattttgcccaaagtgtgtgtgatgtggagggctgacagccttctccattaccagtgcagtgagaggtggcacagctggtgggaccccctctctctcatggatatgagtgcgttagaggggaggtcttgggccaggagcagatcagatcaacaggattatccagaaaatggcagtcatggcgagtattggctccagatggggagggttagggtcagggtcggctcttctcaccttcctgagcgagtcaccagcgtcgacaagttactcccaacatacagggcctgggtggaggctgagtgctaggaacccaggctccaattctggtaaccaggtgcagatgctcaggagaagaatgcagcccagacaagcgtggtgtgccctccagaggagaggacgtggcatcaaagggctgtcttcatggagagcaggaacagagactttgggaagccagggggccttggcctcagccctgctggcagagggtccccaccatgtagctgaagtgccagggtgcttgtgaggactgggtgtggtccagggtgactcagggcaaggcctgggggatgcatctcaaatccacagtcaccagcctagaaactggggtcacacttcccacatgggttcccacatgtggaaatttcattcactaaataacgacacatcaaggcagcagtatggatggggcacagctgtcaaagtcaccagcaacaagtgcaagaagagaagagggagttgcagccacataggtgcccaggtgggccctgggggtcagagagggcctgccaggggtagcacccaccatgctgaccctgatgaggagaggaaggagggtgtgggatgcaggggagggaaaggtgcctgagagcagcatgcaaacagcctgggctcaggaagagccgatggcatgacaggtgctggggagaaaggcgtgataggtgtggacaggggccacaggaggagggatggtcctcaggaaggggagactggtggctatggccggctgccgaggctagcctctctccagcaaaatgagcctggattcatccactccttttgtctctcccctttgctctgtggtgccggcaggaggaagaggagcagaaaaactgttgctccattcatcaggaagcctctctctctctcgagtggtggtgatggtgtcccccaggggcacctggcaatgtctggagacatttacggctgtcccgactgtgtatgtctgtgtgtgtgtgtactacaggcctctggttcctggaggccagggatgctgatacacaacctgcaatgcacagggcagctcccacaaggaaattattcagcctcaaatttcaacattgcagaacaggtcagggagtgcaaggtacctcctgctctttccagcaggtgcaaggtgcacagggagaagcaggtgggtgaggtgggaggaggctggagccagacccagcgtctgtggggtgcaggaatatcgtgaggtgacgaggggcccagcggtgagtgatggggaggggtgcactacggcaggccgccaggggcggttccaccaagaaagtgacatctgggaggggcattgaggcaaaggggccgcgagagggtaggtgctctagaggtggcccacgggcgggcggcactgaggccgggcctgcaggggaggcggtgtggccagcggactcttgttgggtggcaagggaagggaagaaccacagggctgcacaggttccgagggggcctagtggtccgcatttgcccttgggtgggcggtgggactgggaggacaggagaggagcgcggggcaagcccctaagaggcctgaggggtgggagggagaggacggcttcccatacgcccatttagaccagaggagaagcggacccactttgagggctggattctcagccgatccggcctcagctgtgggtccacgcggctcaaggaccagggaggaacccaggtgtgcggctgcgctgatcggcgggctccggacccacctggctggcctggggacctgggaaacccggtgtggtggggagaccgcaagcctggtcaggggtcccgctcccaatggggcgggtctcctgtgaggaaggcggagctcagggcgggtagccccggggaccgggtctctcgcgggggtgtggccacggcccggtgggcggggcctgctgtggacgcacagaggtctgcagcgcgcggggcggaacctcccgaggagagggcgcggctgggagcgcggggcggggccttccgaggagagggcgagactgggagtgtgaggcagggcttcccacggaatgggggcgcggagccggtcctcccgaggagcgggcgcggctgggaaggcgggtcgggtcctctcgaggagcgggcgcggctgggagcgcggggcgcggcctcaagaggagaaggggcggtgggtcctggggcgtgccagaacccttgaggaagaagcgctggtgttctggagtatgaccaccggagccggccgggcctcgggttggggcggggcctcaggggtggggttgggacttcgggatgggttctccagaggtgagagctggggtcgtagggtggaccggcgtctgctgaggaaagggagctgcttggagcgcggggcgagggactcacgtggagaaggcgtgggccctacggcgggcggggcggggcctcaagaggagcgggtgcagatgctagggaggggcggggcccctgggatggggcggtgtctcccgaggagtgggcgcggctcggagcgtgggacttctaaggagagagcgcggctagggggcatgcggggcggggaggggcggggcgggaccaatagcgcatacttaagcggcccgggcgggtaccggcgtcccgccatggctctgcggcgcgtcttgcccgcgctgcgcccctacattccccgcttcgcgccgctgtccacggcgccggccgccagcgagcagcccgccgcgggcccaggggccgtgccaggacgtgggtcggccagggcagtgcggccgctggtgcccgccgtggacttcggcaacgcgtaggaggcgtactgcagctggcgaacctgggagctggcgcgcagcctgctggtgctgcgcttctgcgcctggcccgcgctgctggcgcgccacgagcaggtgcgcggggtgcagccggggcgcggggcttctgcccgtcccgggagcctttacggagtttcctggcgtgaaacgggtgcctcccaagcatctcctggagcaagggaagccaggaagggaggcgtttcctgcagtccctttctgatatcgcgaattttcctacttctcgatgtctaccaactaaaaacaatggtcgttttaatatttacgatatataccacttgtgggaatacagagttatcacttggaatttaaaatggagtattcttcatgttgacacaagagaagcctggtgtagggctcatagcctggaaccccagagttcaatccccgggacccagccgcttcccagacacggccactctgagaacactgttggggaaaaatgggaagcccctcaaacgcccagctttgaactcacccatggtaactttaaaaagtgtcagggcttttggtggcggtggtggggggcaacaagcagaacactgttttagccgcatcagcctaggggtactagagatgacggttatctccaggtgaccctgggaagagtttgcaaggttccgctttttggcgccagggtatctggtggtgttgatttctcaggtgagactgtacagaggtcgggggctgcacccctggcctcaacaggaggcgggggaaggcgggggacggtgtgagatgagaagcaccgagccacacttgagcttaggtgaggcctcggcgggtgcgaggtgagggcagggatccacgaactcagagtcagatgctgttggcccgaatcccatggggagcgccaaggtcagcctaggacccgtggtggcgggagtgcggaggatggtggaggaagaaggagctgaactggacagatggagggctctgggagggcactgctgtgcttgtgcacacaaggatgtcttaaggtcaagttttggccatagagagccccggccaaggagacaggagggcgagaagggacatcccaggtagaggaactggcaaggtgagggacggcgatgtggaggctttggggagtgcccacatctaaggggcatcccaaaagaggagccagtgctggtggtgctgcaataggaggaggaggcagcagggcaggaatgccaggggagggagtggccagccacagggcaaggacgggcattctaggtggcagctgagtgggacagagactagccatgcagaagccatgcccaccttgtggccaggatgtagtgggggctaggaaggcaccaggtcaggtttcttttttcttttttttctttttcttttcttttcttttccttccttccttttcttttctttttttttttttttatggaattcgctctgtcaccaggctggagtgcagtggcgcgatctctgctcactgtgacctccacctccctggttcaagcgattcacctgcctcagtctcccgagtggctgggattacaggcacgcgccaccacacccagctaatttttgtattttcagtagagacagggtttcatcatgttggccaggatggtctcaatctcctgacctcatgatctgctcaccttggcctcccaaagtgctgggattacaggcatgagccactgtgcccagggagctggtgccgcatcttctgcctgggaatcccttcctgacacagcctctgggggccagagatggggggagcagggctccaggggtagagaagccagaggtcactaaggcccagtgtccttccgtgttagaaacacccgaccctgcacagccccatgctggccccagcagccctccgtcaggggcagcgggtcccaggcctgtttatgtttttgtttgtttgtttcaaatgagactgggtcttgctctgttgcccatgctggagtgcagtggtgtgatcatagctcactgcagcctagacctcctgagctcaagccatcctcccacctcagccacttgagtagctgggtctacaggtgcatgccgccacacatggccaagtttttttttttttaatttttgtaaagaggaggtctcacagttgggcgtggtggctcatgcctgtaattccagcactttgggaggtgaggctggtggattgtctgaactcaggagttcaagaccagcccgggcaacagggtgaaatcctgtctctaataaaatacaaaacattagccaggcatggcggcaggtgcctgtaatcccagccactcgggaggctgagacagaattgcttgaacccgggaggcagaggttgcagtgagccgagatcactccactgcactccagcctgggtgacagagtgagactccgtctcaaaaaaaaaaaaaaaaaagaaaaaagatgaggtgtcactatgttaccctggttggcctggaactcctgggctcaagtgatccccccaccttggcctcccaaagtgctggaattacaggcgcacactaccacacccagctaattttcatattttttgtagagatggtatttcaccatgttgcccaggctggtatcaaactcgtggcctcaagtgaaccttccactttggcctcccaaagtgctgggatgacagggcataccactgcatctggcccttctgagcagtgcttggaagccacctcctgacgggggctgggggtcagagtggccagctgaatgctgggccatcagggtgaggggcgttttctcctcatccattgcctgttctcctggggcagatgtaaggggaaggccctgcactggggtggtgttaaacaagatgagatggtaagatctgctttcactttaaaggaacatttctggttgttgcttggaaagaagtgtcaggggcaagaatgctgcaggagggctggcctggagggcagggtgggactgcaggctggctgcacgggggcaggagcctgcgcttgcgtcagaggttcctgagagacttgggctctggggcagaggcctgagcaagggggcctcgctggggtgtctctgtcttagccacactcggtgtttctgggtcctgtgacccatgtgtgagcagcctgtggtgctggtggcacaggggaggaaaccgaggcagggagcctgtgggggctgctcggcaggggacaggcagctcctgtgcccactgctgtcccacacctgcatggaaacacaaaccccaccacggagccccctctcatctctacagggcctccagagcgccatgtgcaagaacttcatgggcggggtggggtggggtcaggagcctgctgtgggctggccaggcatgaacaccaagctggaggtggcggtgctgcaggtggggcagccttccccttccccactcctgtggcttgtgagggggtgggcaccgtgggggcgcacagggggcatggtgggcagtggtcggaggtggttttgggaactcacccagggcacgtggctcactctgcagctgctggggttggcctggtggggaggaggaggtcggagggactctgaacagagaggggagatgctggcaggagggctggagacccagccctgcagggcgtgggcgtgcatcagcagcggggtgggaatagacctgtctatgcagtagaaacaaaccagacatggatcctgttcttactaacgatgtaataaagccagaaacagcaccagaggccaatgggtggggggaagaataaaatgtgagcgaatggggctgatccaggccttctcacttctcaaggaaagtgtcgcaaagatgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccttgggatgacagtgctgaaggaactgcttttcacacagcaggacttgatggcctcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggggccaggggctgggacccaggtcaccaggagcctccagttgaagtggggaggtgactggggtggtgcagtagtgagccatcccctcacacactgccagccttgcccactgtgtcctccctggccgcccggagctgtgtccgcctcctgcctggctgcctgtgctcggcccctccacaagcccaaaacagccctagggtactcagtgttttcagagccgcctagatgcaggactgtttgtgttttggttttaaatttttttaattaatttattttttatagagaccaggtctcaccatgttgcccaggctggtttcaaacccctgggctcaagtgacctgcccgccgcagcctcccaaagtgctgggattacaggtttgagctactgcacgccactggttttaaatttttaaacagaaaacaatatttacatttcctctgtctttttttttttttttttttttgagacggagtctcgctctgtcacccaggctggagtacagtggcgcgatctctgctcactgcaagctccgcctcctgggttcatgccattctcctgcctcagccttctcgtcttttaaaactgaacactgaggtgggttttgtggtggttggtgaacggacaggtttgggcctggatcccccacccgaccctagcacccacaggtggggtcgccaactctgctgatgtgcctcctccctcagcactgtggacctgctggactggagcagcctcatcgacagcaggaccaagctgtccaagcacctggtagtccccaatggacaggtaacacctccgctcctcagtgaggcccagctcagcagggcgctgcgctaagaagggaattcagcctgccacatgtttctcttgttgcctaccctgggaacttaacatgaccaagatcactgcacactatggccccacagaccccctatggtccagggggaaaagaagacaaacccactagtgtccacagagtgcttggtgggacagagacccacgcggagccttaaaacaccacaaggagagggggtctgggggccttccccaagtcatctgtcttgtgcatcaggtcaccccaaacttcagaggcctaaaacggcagcagccactctgcttctgcctcatggttctggggttgacagggctcagctgggcagtcctcgcttggggtctcctgggtagctgtactcacagagtggtggcgctgggacctgggggaggcgcccactcacatgtctgggagttggtgctggctgtggcttgggctttttcccaacatggcagctgggctctaagggccagtgtcccctgagacgtgagagccaggcagaagctgggtgaccttttcctgcctcacctcagaagtcacacggtgtcttttctggcaagttctgtttgttagaagcatgtcaccaggccagcctgtatactgcggggagaggaatgagactcatctgcctgtgggaggggggcccaggacctggctgactgcttgaaaccacaacctaaactggaattcgaagaaagaacagaagcaccttcagaaaacatcctgcagaggcagctttccatgacacatctagccccagtccactaagggcccagcctcaaactcagagcccccgacccagagcctcggggcgcagtgcgtacagtgtggctgtgcaccaaggccaccagctgttggagactttagcatggtgtagcaagggatagagtggtactgcttgtgcccagtgaggcaaggctgctggggccagcaaaggggtgagcgggaggccctgcgggatgggtccccacggcctctgagcaccagctccttgaaggcctcatcctggcggttgccctggtccctggctacgtgtcagcacgtgctgcacaactgccctgtctgcctgtagccaggggtcttcctcctgggccctcttcctgctctgggtggagcccttctgtttgacgattgggtggtcagtgttcacttcctcagtgtcacatgggagctgcagggggccctcccacaatggtggggcctctgtgagaactggggaggctgttagagtacacacttcggagtgcaggcctggactgagcctggggcccactgacatgggcactgagctccctcctggtacccccagggcccgcgtagggcagtgcactggctgcgttggaggttccggggctctgtgctgcttgtccaggtggccctccctcccggccctgcatgagagggttcccgtgggctgggaacactaagagaggtttagcctgggcctcagggtggcacttcctggcccttgctgtggcctgaccatgtgctgtacccccagacaggacagctggagcccctgctgtcccggtttgctgaggaggaggagctacagatgacgaggatgctacagcggatggatgtcctgcccaaggcgagctgtcccgctcgggcagagggctggggccttggggacccgggactcatgcagaagagggcacctgcctcacttgagcaatagttgctcccactctcccaccccctgcgcctctcagaaagccacagagatgggcgtgcggctgatggtggatgccgagcagacctacttccagccggccatcagtcgcctgacgctggagatgcagcggaagttcaatgtggagaagctgctcatcttcaacacataccagtgctacctcaaggcaagcccccgctcagcccctccctgcctgccttggggcttggagaccccacaggaggggctcctctcatctgagctccctggcatttgcctggttttatactcagcacccaccagggagctcacgggatggaggagggagtgggccgtgcccccaaggggttgttggggtcttctgcagcacagctcacccagcgggccccagggtccaggaaagagccccttaggtggtggccacagccaggcctgcagaggaggccgaggccagggtgactgcctcagagtagcaagaaaggcccgctgcccgcagcctctcccctggttctcagaaccagccaagagtgtctaaggagcaagaggaagacaacgatctttatgagggtccactagatgtacccgacaccccaaacttggaaggtgtcacatgaccatttcctccagcgtgttttcagttcagcgcccctaagaacctcatgaaagctttgggccctccccggaaagactcacccaggatgtcacatgtattcagggagcccatcctagcctgtgggccccaaactgctcagggatgttagcaggtccagagctctcaggggtgagccgggtgcccagaggacacagggtggcatggggagggggtccaggcaggagcatgcagtatgcacccctcctggtcggcctgggagtctggagcacatgatggctgctggcgcctgggctgcccccatagggctgtccacaggccacagaggaagctgcagatgtccccactgccattgctccctggagacagaggttggagaaccatcctcacccacacctggtccaggtgccttgagctgcacctccccaggcagctgctgcccagccctggtgactgcacctgggcccaggaaggccccatcctgctgtcacttgggcttgcccaggctccctgtgacttttggccctggccccacaggatgcctatgacaatgtgaccctggacatggagctggctcaccgtgagggctggtgttttggggccaagccggtgcggggcgcatacctggcccaggagcgagcctgtgcagcagagatcggatatgaggaccccatcaaccccatgtacgaggccaccaacaccatgtaccacaggtgcgcagctctcccacccctctgtcttctcagggcagggcgccaagaaaccaggcctgagggagaggcttggagactgaacttgtcagccacatgtgtccccaggtcagaactggtatttcctcagcttttatgtcatgtgttactttttcaaaagcattaaggttattcttttataaatatagaaaagcctattgaacaaagtaaaattggccacagttccctgagcctgctcctgcagacacttagatccagagatgtgcatgaacactcggtcctccccaccctgcaggctcagcctgtttgcttttcagttcacacagtgggatcgcccatcagctgttctgcacctgcttttactgctctagtttcttggtgatcttttcatgtagcacaggctggccaaccatgggcttttcctcttagaggcgtgtgtgcatgctgcaaattcagagagaccccaagtgcctcctggttggctccagctcccctcctgcagccgctgtgcatgtcgtgccacagcgcacacatctccgccattgttgtttgcgctgtagcgtgtcctctgcccgatgtgtttttcatttcgcgttccatctgggtcctcttgtgtgggcttgcagagtggtgctgtcaacagccagcatggagtgcccggggctatgtgtccagcatctttgatcttactggttttcagtctggttattgtaacagggactcgctggacataccgtcaccctctgtggtacacacgggccgtcaggggttttgtgtctgaggatgcagctgtcctaggttgctggaaatggaattgctgggtcagagagaacgtgcgcgtggtcaagcctgctgagtgtcctcgctgcaggagggccgtactgctcgggcttcctggtgcaccgggatgcccacccccactgtgccctacagggacctgcttcccttttatttcctttcagggccaggggtgcactgtacgatccctccccagacgcaaagctgtgtctgtcatgaggcttatgggcatgtttgggctggtccccagagtcacggcatgtttgatgcagggacgctgtgccccagctggttctgtgtgaattgtctggtcccagacatcgcttttgcttggttgctggtctttctttttcatgaggtgctgggaggggcagatgctgctcctgttcctcctgatcctgtggatacccttggaaagagccagctcactggatggatctgggtctgccttcggcctcctctctgtgcagctggtaatgagaggtgcaggcgaccacaggcctggaactgggctcacatggcactcttcacaggtgcctggactacgtgctggaggagctgaagcacaacgccaaggccaaggtgatggtggcctcccacaatgaggacacagtgcgcttcgcactgcgcaggtaggtgtgccccaccctgcaccgaaaccccaacctgagccgttgtctcctccagctggggagaggtggcagcagtgcagagctcagggtgggcagagtgacctgctgggtggtcgggcatttgtggggaaaggctggtgaaatgagctggagggtggcttcagtgggcaggcccaggcccgctggcattctggacatcggactgtgagagcacaatggctctttgcagttacgttggtttttaaaattaacttttttttttagatagaatctcgctgtcacctatgctggagtgcagtggcgtggtctcagctcactgcaacctccgcttcccaagttcaagcaattcttcatgcctcagcctcccaagtagctgggattacaggcatgtgccaccacgcctggctaatgttttgtatttttagcagagacagggtttcaccatgttggccaggctggtctcaaactcctggcctcaagtgatcctcccttcttggcctcccaaagtgctgggattacaagcatcagccactgtacccagccttttaaaaattaacatttgacttattaaacttcacaattaaaaaactaaatttcatcagggtattcggatggctcctgaaaggtacaaatgtagtgttggagcccagtccctcaggaggcctccacagcgctgcctcatttataagcagttcccttaacattttaactacatctggaatgtaacggtttgttttctctttaaacatttgtcccatggagcacaacttcggtagaattctaacaagtcaaatgcagaagttaggtgaagtcagttcttggatactcctgtactgtcaccctggtcttatctcatgccttagcccaagctatgcacacaatggggtcctaggtccccctcccctcccagattccgccttcccagggatgggaccccctagaaccctcggaggcctgggcagtggcctcgctggctctcgccttcctaggagctgagcaggagctccactctcagcagggcagggtgccccagatccatgacttgtggcacgaaggggctccccaagaagctgtgaagccacagggccaggcttggggccagggctgcagccaacaggacacatcctggtgctgctcgggagctgactcacggctctgaaatcattcagtgatgtccacattcagcctttgtttacgatgctgctactttttcatggcctgaaattgcagcacacccatttttgtgccctgatcctctgctaattgtcatagatgtgtcggtgatgggacagactcactttctccacacgcacaggcctggtggccagcactgcccagcactcgggagctggtgggggttcctctcagcttgtaatcaggactcccagcctctgggtggactctcaatgctggtggactcacagcctgactagacacatcaccatccaactccgaaaggacagcccgccctcagcagggcttcctctctccagcttagccccggcacctgtctgtccctactatcttgctgtggcagtggcttccccagtggacacagcttccccctcccgagtggcagccgggctctctcctcttggccccaagggccctgtgccgggctcccccagtaccatgctcacatccctgcctgagaggctggacccctgcaggcttcagctctgcccctgctgtgggtggctggggagctctggggagctggggtcccctcccatgggtaagtggttctagactatggcagctgctctgtcctgtgctgggcccagactgccacaccacccaccctcaaacaacccgagttggctttggccaaggaacaaaccagccccaaacttagaggctggaacagtggcatgttctgtaggccaggggtgggctggctcagctgatgcttctgctgctggctgtgcctgtgtccctcctgcgtctgtgatctggggccggtggggcctaatgagctcattcatggctggtgtagtaaaggagactacatcctgggtccagcgtcccacaggccagcccaggcttgggcacgtggtgggctcaggcttccagaaggcctggagagggcaagcctctgcttgtgtcacctttggtacctccctgttggccaaagtgcctcacgaggccaagcccagatgccaggtggagtgagccactgtcctgtgctgggaggagccgcagtcacatggcagaggctgtgcacaccagcaggggagggggcagccagcagtggcacccggctctcgggttcatgtcctggggttgaggaagacacaagatggaagccagggcgatgtggcagagatgggtgcctgctttagactgggtggtcccgacactggagcccagcccagggatggagggaaagggcctctggccgatgggtactctgggagccagggctggggcagatggagaacaggggaggtgaggccctcggggagggagtgggaagcacagcacaggcactgccagtcacccgggtgatgcgtgagcagcaggcggaactcgccccaggctgggggacccagtgctgtgcagaccagcgaagtcgggatacctggatatagtaagctggagatgaaacttgagaactgtcactgcgtggatatttcaaaccctgagaatctttgtaagaccctatacggggtggtgtgaagacaggacagagtggaggccccaccccagtatctgagcagtgctaatagatgtataatgcaagccacatctgtaatttaaagttttttggtagctacgttaaaagataaaatgaatttcaagaatacattttaattaacccaaaatatacaaaatattacttcaaattgtattcaagttgattttagaaaagcaatgcggcatcgtgcatttttctagaaagtctcctaaatcccgtgtgtatttgacatttgcaacacatctcgattcagagcagccgccttccgaggactcgggggctggtggcagctgtgtgggacacagcagctgtggggatggggcagagcagcagcccacagagggcgagggcaggggccggagaccagtcataccacagaaccctggaggggcttgaggaagggatggcaggagagctgaggagcttctctgccctgtggggcaggctgctgggtgggtcaaagccccagaagggctgcacctccaagaagggaggtagaggagaggtgggagagaggagggtagggaaggcaggaggggggccttgttggctaagggctgaggcctccccagggagaagagtagggcagcccagcagagtcctgctgggaagaggcctcactgggagagggccggacagagcctatatcccaaccccacttcaaaggggataaagtctggagagtgtagatgggggacctggggtggcaggacagggtcagagctgggacaggggccctgtacccctgcaccggggacagtgtcctggaattagccctcagctcctggctttacctgcacaggatggaggagctgcgcttgcatcctactgtactttggacagctgctaggcatgtgtgaccagatcagcttcccgctgggtgaatggggccctccctggtgcgatggagtgtggtgctgggcctgggcctcatggcattatctgcccccatgcaggccaggctggctaccctgtgtacaagtatagggctgtaggtgctgtcatacgtgtcctgccacgccctggagaacagcagcctcgtgaagggtgcccgtcgggagcggcagctgctgtggctggagctcttgaggtggctccgaactggcaacctcttccattgccccacctagcacccccccgcccccgcccaggccatcaccacagctgcagccaaccccatcctcacacagattcaccttttttcaccccacacttgcagagctgctggaggtggagtcaggtgcctcccagccctgccaatggtgggggcactcaggtgtgggctgaccctgatacctgcctgggatagccgctggtaactgttaggaactttcctcggatgtgtgggcccaaggcccccacctctgtgacccccatgtccttggacctagaggattgtccaccttctcccaaggccagcccacatagcccgagcccctcggggagcagtggccgggctggggaggcctgcctggtcaataaaccactgttcctgcagctgagagccctttgccctcacacagggtcagctctgggcaacaaagagggagtggctcagacagggtcagagaagtctcatcccaaactctggcttccagcatcatctgttcctggaggccaggccctgcgcagacctggccacccagggtgctggacacccccaaccctgactccacaaggacccagcagggcccatgggcccaggccagcacggaggggactcatgcagatgcagaagccaagctccccaggtggccctggcatgcctccccgcagggctcctcctcaggccattcctgccaccctgagtcctctatcccagtgacctgcatcaggctcctcctagtggttcccacaggacactgaccaggctgcggcaggcgcatacttgcactccgggccttctcccatgctctccagcccccagccccacaaagcaggctggatgtggtcctcatgccctggggcttggatgggggcccctgtacagatggcagtgacagcatcctgggaccagggctggggcaggaaaggctggagggtcccagtctccaggcagggggaggggtggtgggctgggcacacagcccaggaaggggcccccaggtagaggcctctgctgcaacagaggtgggggccctaccagggccccggttatggcagaacctgcagctatcacacaagccacatttgggccacactgaggcatctttatttctctgggtcacacagagcttgggcctgggagcctcttctgcatgggggctgcagctgccaagggagcggctgagaccagaacaagcgctcgggtgggccccagtgcaggttgggatgtgcccggtggagtaaggtgtgagaacccccagcctcactctctgcctggtcctgaagcagacagcagcaggctggcccagcctcccctttatgagactatcctagggtttgacagcaagtcccagatgaagggtgacaggcagctggggtccacctggtctctcctcagcagggggaaccccctgcgggcagctgggaaggcagtggccaaaggtcaagaagatgaactctgcccagacttctgctgcctgtggctatggtgggacagggctgcctttctggtcacactgggcagcaggcgactgccagggacctcccagtcccagggctgcattccctgcccggcagcccctctgctgcagctttcggatgagttccagcaggttcatctgcagcatcagctcctgggatacagaggggccccatgaaggccagagtgacccccaggcccctttcatcccggcccaagggtgccaggcagtgagcccacgggggcgaccatcctgtgaagcctggtcatggcctgccaggacagggtggaatctgagcttctgcccccaacagggccactcggaatctgagcctctgcccccagcagggccactcggaatctgagcctctgcccccagcagggccactcggaatggcatgcgggaggggagcagaagagggccctgtgtggcacagcaggcctggagagggtgggcagtgcccatggctggctggctcaccctcctgtagggaatgggcctggcctccgtgctgggaatggcacagaaatcctttccagagcctcaatccttccacttcacccccataccctgagcctggctccccagggaccagcagtaaaaccccagatggaatggggccccggggcactcgggctagggcagagcaggcccaggcactgacctgtgggttggtggtcacgtagaagccagccacccccgccttctccagtgtgctctgctggtcagccaccttccggtccagctccaggatgatcttctggtccatcgcccgctgctcctcacggatccggtgttccacggcctgccatggggccagggcgcggagggggagaggtgagggcagctctgccatcagggggcggggaggtgagggcagctcaaacacatgctcctgctgccgtccccagtggcagcagctctgacaccaccggtgcatcctcaccacacccaggcctctcctcggccatgtgaacccctgaagggggccccaaggggcttccacgaatgccctggcttgggactgccttaggaccacacacacatctccacaggcacaccctgccccacggcttgttggttacatgccagtctctggttgtccctgtgctccctgggagaaggatgggccccttcctggccccaacaccctaccattgcctttgtacccccctgaggccacctgctctgtggaggcccaaacccacgaggagctgctatccaggggagcactggtgggttctcaacctccacccagccccagcacacttggtatccgcaaagaggagccacctggtgggactcactaggcctccagtgtcccactcaggcccaggacagccacccatgcctgagcccccacaccccttcagctcagcccagtcagcagagccaggtggtgcccacaggagagctgggccggccaccctgcctgcgcccccagtacctctagttctcgctgctgagccgcctgaaccacaggcaggttgtggggccggcaggcctgctgggcttcctggtgcttctgccgcagcgcctgcctgagcactgggagggatgagagcccgtcagcaggcggtgggactcggcagcagccctcacccatgggcacctgccttgccagcccagcagagcagccaggccaaaggggtgtctgcagtggggaggatgccagcctcctccatcctcccaccccactgtcacccagggccgggcccttatctggtggcaagtctccaggggactccagaaggtgcggggcactgaaagagtggggtggggaagactggccaggtggggccaaagctgcagccccagacccagggcagctggaggaggcaggcgggagggaggctgcagtctgagggcttcagggcccccatggccacaggccatgagacatctactcaagtgtcagagaccacctcaggcaaaggcatgggaaaggagcaggaggagcggggtcgctgaccctgagcgtggggcctctgcctaccaggggtgtggtcgggccctccaccctcagtgctgcccttcagggtagacagcccctccctcatttgcagctcccagcccccgcacagcgccagagggagaagggtgggcagacctgggaggcccaagtttgggatgagcttggggtgccataagcctgtgtggctctgaggggctcaccctcagccatcaagtaaagctccacggtccttgctaaactgtgcacaaacacagatgtgtgcaaactgtctggtctgaagggaatgtacagaggaagcgatcatgggacataaaccaccatgaaacagaacatgcagcaccccacagctggcgccagtgaccagtaagtgccaaatggctacagctccccaggagggaggggtccctggccaaaagaaaaggtgaaacccaacactctgttcctgggaagagccctgatgttgcagctcttctctggtggccagtccccagggaactccagggcccctgaggctcccctgcaggtagcctggctcccgctgtgcctacagccttccccgatctcctgtctcttcacattctgtacacacctcgacgatggtatttaccaaaagcccccctcaagacagctccataacacagggaagcagggaaatgtcatctccttcactctactgatcaaacattgctacaagtgccaggtccactaccagattccactagatagacaaccaaaaggcaagaagagagccacgctggctgcctgggcagaaggggcctggccttagacatgaccagggaacacaaaggaggcaggagcagccagtcgcccctgccaaatcagcaggagaagcagaaagtcaatgcaggcatgcctgctgctggtggaaccagggcctggcccaaaccttctgaagcacaaacagcattgggcccaggcagttactaaaactccccatcctgctataaggaactatagctctgtggaaaaatggccgattccaggactgagacacggagaaaacaagaaaagatgagcctgaacacatacctgaaccagaaagcaagaaagtgctcacagaatgatggggcggcatctaaaggtgcctggagcgcccccaactggccacacatggcacagtctgggcattaaggaataatgagccatgcgcttgggattagtaaactacatacatcttacagctcaataaaaaattttaaaaagacaatcgcccagacatttaggggaagaagtaatgccaattctacacaaactcttctggaaaactgaagaggagagaacacttcgaaactcatcctataaggctggcaaaaaccctgatacccaaaccagatattacatgaaaactatagaccacagtttatcatgaacatagaccaaaaaattcttaagattttagcaaatcaaatccagcatacataaaaaggatactacagcacgacccagtaggatggaattcaagtgactgtaattcactgtagtaatagaaaatgattcaccacgtgatcatctcaagagctgccgaaaagggaactgccaaaatccaacatccattcttgataaaaacacaccaatcctggagcagatggacactgcctgccttctggggaagggggccttgcactgctaggagaaatttttgccacattaaacctgcttctaatcaggcttctaccagcagtccagtgtacaggaaacccagagagtggagaagcaggttaaatgcaagaggaagcatttcgtctgatagatcaagagcagggcattctataaaattagaatgccctggactctacaaaaaagtcaatgccacaataaatgttggggactgtttcagaagcaaagagaccaaagtaaccaattgtagtacatgaacttggactggatccttacttataaagcaacaatttgccacaagttaggtaccatgatgtggccgtgcactgaaagtcaggagacacccggaacagttaatttctcagggggctaccttctgcagctgtgtaggagaccagttttgttctagagcacttgctcccaatccaaggccaaggttgaccccaccacccaggttgtctggaggcattcttggttttcaggactagggagggtacccctgccatcctgcaatgcgcaagacagcatctcaccaaaaagacttacccagccacaaatgtcagcatggctgggttgaaaatcctggtctccaggaatgctgaagactcttggtgaatgctatgctgtcacatgtatatattttgggatgtcaagaactagagcaaaacgttaactattgaactttagtgaagagcacaagcgtatgcactatactatcttttcagcttttctaaatgttttaacttctaaaataagaagtttgggaaaaataacaaaggtggaaactgatggtgcagggggacctgccctatataatttgcaggaaagggctcccaagcccaccaagcaggcctggctcaagtgggaagctcttcgggtttgggagggcgccacaggagacagtgcttaggaatttgatgtgcaactggaatgaggccctgcgaggcctgagagggaactgaccctgaaagacgcttgctgcacaactgtcaacagacttccaactactgaggggcaatgctgctgcagtcagcgccaccaccagagtctgcctgcaggccaatcaggcaccgaggcctagggccatcctgtctggaagcgcgtggggcacagggaagcccgaacagggagtttctgctaagaaggtgggtgctgcgcaactgaaaacaaaactggttggacccactgatcaccaaaaaggcgctgtctcagtctctgcgcccgttgattttgtcaatcttagagacctcttccgaacacttccaaggaaggagctgatctgcacagataccaagagctgcccggaggcgccgacccggaggaggcggcacctcatcccgctgcccccgcgcacctcggtgctcgttctgtaggcgcaggcgctggttgtacaggctcttttcggtgaggtgctggatctccagtagcccctgcacgatttcgaacacggtgccgtcgagaagcgccagggccaggtcgctgagcgtggtgtaggacaggcgctgctggaaagagctgcgggtaggggggcgcggtgagccccggcgggaaacgaagccgcctccgcaggcctccgcccgccccgcctgcgtacctgggcaactccttcaccaggctctgtagcgccgacagcaactggtagtgtcgctcctgctgccgggcaccgtccgccacctcctccaaggcggccgcgtagcgctccatggcgcggacgcccgctagccgccggcggcggcgacgagctcccccagcttcacgacatcccgagcgcggcgcgtcccgccccttttacgattgtcccacgcgcggcgcgctccgcccccttttacgacagtcccgagagggcctggccgcctgccccgccctgccccgcgccccgccgcctgcttattcaggaggcgcgccccgctcctctgcggagactccaaggagggttttgctcagcccaggctcgcacctgcctgctccccgcgcgacattaaaggcgagactccgccgtctggatatcgcaggaccacggagaatcccaccggcccttgctgagtcattgcgggccgaggtccgggctccgcgccggcgcgcctgcgaggtggactgtcccggtcaccggcctccccagaggcaggggtctcgggccagagcccacaggacctgggtctaaggcaccatccgcggccgagcagtggcgctggggtctgtctgcgtcctccccgcccccggggtgagacagacaggaccgccctagagcctctgggtcaggacagtcggagccagagtccccatctgggcctccgtggcccccagcccgtgagcccagactgcgctctccccgctccacaggccagctgctgggccggggctggggggcttctggtggctggggctgaaccgtctaggaacaggctttaataggaggggctcgggtggaggaatggctcctgcaaaggccctgccagagtcaggtcaggtgggtgggcgagaggaccagtgtggccaggctgcggaagccagcacaggagacaagggcgggtgctgtgcattacagaggctgctgggggcttgtccatagagcagcagggggcacggaagggcttggggacgcagacacgatcagacttgcatttcatcaggcactctttagctgcctgctgggtggctgggctgtgtgagatgaccctgctttgaccaggttaggaattatgactggtttccagagagaacattggttagtaattggctatggggaagagggggcgttgagccaaccaactggggtccccctgaagtgccagcaaagtgtctggttttctccaggatctgtttcctcagtccctggcaggattggctcccctgcacgccatgtccttgtggtcccttccagacagaaaccaggcatgaataaagtgaataatgacaagcgctcaggccactgccgtggagggcggtccacaacccagagctggtcatgcgccgggcaccctggcctccaggtccctcagaatggcaggagctggaggtgggactcgagattgtgggagctgagtctgtagtgagtgaccaggagccagctggggctgggcttggtcactgtcacctcccccggaggtggtgagtgggatgattagctgggtgaagacgcctgcctgtttcaccagtgtccctgccctcagtcccccagtccatgaagagtgtctgtgtggagactgggaggatatagggcagccccacgtgatgatatgtctgtggccagctgggcaacactgtcgccagctccggggtctgccaggtggggtgggggctgtgagccacagcaggagcaggccaggcctgggtttggacacctgctcctctgccttgtccgggtgctgatgcaggaaggccccttctccaacccttggtgcaacgtctgacctgaaccagcttccccagcccagcaacactgctcccctaatgtggatgtcaacctaaagaaacaaactgaaccacagttcatatagagagtttgtctgggccaaggctgagagagctgcccaggacacaccaagttgccctgggagtgcttcattcagccttattacaagcaagtttttaaagactgaaggggacaaggagtgggctgatatgaagtcagcaggaattctgactgctttccagagagaacccttagtgactggctataaggtgttggactactgggtaagagttatggtgtccagcgtatggctttttatgcctacttggtgtcagtctggaacccacagagcaattggcttcaagaggtcgttagctcaagtaggagtgggatgtgactgctgtttcattccagtgcctctctgggccagataattaaagggagctcacattcctcagataaaaaagttcctttcgcattaggagaaatacgtaatgtagatgataggttcatgggcacagcaaaccaccatggcacgtgtatacctatgtaacaaacctgcacgttctgcacatgtaccccagaacttaaaagaatatatatatgaatatatatatatactttatacatatatatataaacttccattgtgcgcgcgcgcacacacacacacacacacacacacacacaaagttccttttctttttcatggacatgagcagtatgtcactcaggcatggggactcctgggccacctctgggtcttcagggagggcctggtctggaaggaggggtctcatcctccagagccccagggatgggtgatatatgtgtaggaatgggggagctggttcgcagacgtgcgtttcccctgtgtgtgtggacacgatgggccccatggctcttcccgtcgggtggtatccaccgaaggcctttgctctgcggccactgtccacctccacttggcctcccgagtccaccaggctggctggtgacaccttgggttagtgtggggtgactggtgtgtgttggggagctgcaggtcccctgtctctgacacagctgtgtctgggcaaacaccaaggtttgaaggagtgggtgcctgtgtgtgtgtgtgtgtgtgtgtgtgtgtgtgtgcgcgcacgtgtgtcaaaaggctttgctgcatgccttttgtgtggctctttgtcacatgtgcctttctgtgtttctctgtgagttttcatgtgtcaggttgtatgtctgttgtgtgggcggagaaacagctctgctgtggggccctgagccattgcaggatccccataggccatgcagaggtgcacacagcacctgacctaagcctgctcctcccagaacatcaggctgcacccaggccaccgctcactccgtctgtctcccgagactgttcctcacttcctgcctcactggccctggtgagggtgaggctccctgcccccggccctcaaaacagagctgcagatgaggacgccacccagctgcagtgtcaaggggctcctccacagtgggtgtcccgcaacgcatgctctctgaccccttttgtttcagtgttgtcctttttagtgtgtggcaccaggacagcagggagctgccacctcaggcttctcttattttcactctgtgagtaataaggtctgaatgagaggggctcattgtgtctttactgtcaaatcagtcaggccttggccttggcatgtcttgcgtgtgcttgacaaatgtattgctcatggggtctggtggaggcacagcacccttttagaagacagggtctgtgcggaccagttacgggtgacatttcctaggcacagctcttgcctaagtggtgtgggatgggaggagggcggggcttcccactgtcccaccagcaaaatgggctgtgtggccagctcctcaggacccgagagcatttgctccaggttgataaaatgttgcggtgttgggtggcaagagtaggattgaaaccagccacccagttggtgctttgttaccatcagaagtgtttgctgagtcaaagcaaatggccactcaaaactgagtgggctgagtgtggtgactcacacctgtaatcccagcactttgggaggccaagatgggcagatggcttgaggccaggagttcaagaccagcctgggcaacagggtgagagcctgtctctacaaaaagtttaaaaaattcgctggcatagtggcatgtgcctgaagtcccagctacttgccacttgggagactgaggtgggatcacttgagcccaggaggtccaggctgcagtgagctgagatcacaccactgtactgcagcctgggcaacagaacaagaatcaaataataaataagtaagtaagtgagtaaatccatccatccaccccagagtgagtcagctggggctgctgcattgctcctccctcacccacaggattccctggttccagccaggagacgatggtcaacagccactgctgtagtggtgcctagttaaaactctttggtttctgtctctgtaaaaaaaagtgtctaattgcatttgggcaaaaaacttgcagtgaagagagaaaaagagatgaaagcaacctgtgagggaggctcgggttgacgtgcggcatgtgctgtttgagtgtgatgagtgtgtcggtttgcactgtagatgctcaggaagtgaggatatgtggagtgctgactgtatacatgatgcctccactggctggctgagtagagtttcatgaaacaatgttggtggactcagccctgaatccctcaggcattcagagagcaacctctgtcttttttttttttttttttttttttgagatggaggctcgctctgttgcccaggctggagtgcagtggtgcaatctcggctcgctgcaacctctgccttccgggttcaaatgtcctggctttaatttcacagattctttcttctgtttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggagtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctgtcttaaatcaattattttgaattgtcagacaatttgtagatctctatttttggggggttgattacaggagatttatgagtttattttggtagtgtcatatttgctgattcttcatgatctacagactttcattaatgtctatgaagaagcaaatacctcttcttttttttttttttttttttttgagacagagtcttgctctgtcactcagctggagtgcagtggcgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggcctgctatcaaggcataggttagtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagacgggcaaagcaagactggaatggagtcacagggctactttagtgtccatagctgacactgagatcagcaggcctgttaccaagggcatgtaaaggcatcactgaattcctgggcaggcaagactgactgtggtagagtggggctgaagccaggtcagggctgctttagtttctgcagtcaggaccatggttagaaggcctgttactgggggcataaatggtcatggttcctcctaggtgcttagtggatggggctagttgcaagaacatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaaggaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacgtctgtaatcccagagtaatttgggaggctgaggcgggtggattgcttgaagccaggagcttgacatcagcctggccaacacggtgaaaccccatctctactaaaaatacaaaaattagctgggcatggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaggtcaggagttcaagatcagccaggccaacatggtgaaaccccgtctctactaaaaacacaaaaattagctgggagtggtggtacgtgcctgtagtcccagctacccaggaggctgaggcatgagaatttcttgaacccaggaggcagaggttgcaccactgagctaacaccactgcactccagcctgggtgacagaatgagactctgtctcaaaaaacaaagaaacaacaaaaaaccacaacttatgagttgtggtgaaaggagtgctagggaggaaatttatagctataaacacattaaaaaaagaaacacctcaattcaacaacataagtttacacattaagaaactagaaaaagaagaatgaaactaaacccaaagttagcagaaggaaggaaacaatagagatcagggcagagataaatggaaaagagaatagaaaaacaataaaaaacaaaaccaaaagttggttcttcaaaaagattaataaaactgacaagactacactttgggaggccgaggcgggcggatcacgaggtcaggagatcgagaccatcccagctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaactgacaagactaaggaaaagggaaacaatctaaattacttaaaacagaaatgtatttgagaatatctttatatatttctgtctgtctgtctgtctgcctgtctatgttttagaaacaagtgtctgtctatgttttagagacaaggtctagctccatcgccctggcaacaatcagatgcaaccacaatcagtggcacaatcggctcactgcagcctcgaattcctgggctcgccactatgccagctcttttttttttttttttttttaagagacaggatcttgccatgttatccaggctgatcttgaactcctggcctcaaggaattttcccacctcggcctcccaaattgttggaattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactataagaaaataaaacaacagatcaatatgcctctgatcattgatgcaaaaactctaaaaatactagcatactgggtggggcatggtggctcatgcctgtaatcccagcactttgggaggctgaggtgggtggatcacctgaggtcaggagttcaagaccagcctgaccaacatggagaaactcttgtctctactaaaaatacaaaattagccatgtgtggtggtgcatgcctgtaacctcagctactcgggaggctgagacaagagaatcgcttgaacccgggaggtggaggttgtggtgagccgagatcatgccattgcacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagtttcacattatatgcacataccacgatttacttttccattttcctagtaatgagctttaagattatttccaatttttagctattactaataatgtttcaacaaacacctttggacatctcttctgcaaatgtgtgtgtattctcttggagaaggtttaccttgtggaatttctagtgtgtatgtgtatgtgtgtgggtatatatatatacacatatgtatatattttcaactttactatatatttccaaaaaactcttcaaagtggcagatttaaactccccttcgccgtatataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtggagtagttcttaatcattttttctactaaactattttatatcattaatttgtagaaatcctctttatataatggatattatacttttcaattatatattttgtaaatattttacccaattttctggcttgcatttaacctttatttaggatgcctaggatttttcattttaatacagtctaatttatttttcttttcttcttcatgcattctggcatttgattaataagccatttgttgcccaacgtcattagttctctgtatatacttttaaatatcttaaacatgtaatattcataagtaatttcacaagtagtttaagatttgagtctgtaacctaaatagatacaggattttgtgatatgctgtaatatacagatttttatttatatatggataaaaatttatatgttttttctgacagcatttattggatagtataatttttctactgacttttagtatcatatcttttattacaagtccaatgtattcagcatacctatggatctatttcttggtgcttccattttttcccattgtttaacggtgtatcactgagccaaagcaaaccattttaattattataattaaaacacatttaaatattgataggctattattgttcaaaataactttggttcttcctttccgttgattactttaatatgacttttccaatcaagttctaaaaaaatactggtggtatatttattgaaataactttaataaaattaaatgaaagatcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctgtaatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttatttttttcctacatctgctaagataatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttcttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggcgtcggcccggtgcggtggctcacgcctgtaatcccaatactttgggaggccaaggtgggccgatcacgaggtcaggagatccagaccatcctggctaacacagtgagaccccatctctactaaaaatacaaaaaattagccgtgtgtggcggcacacgcctgtagtcccagctacttgggaggctgaggcaggagaatggcgtgaacccgggaggcagagcttgcagtgagccgagatcgcgccactgcattccagcctgggcgacagagcaagactccatctcaaaaaaaaaaaaaaaaaaaaaaaaaaagagtgcaatggaaagctggtagaaaatggacattgtttaaagaccaaaacaaccacactactttgctaatccctatcagctaaagactagagaatatatgaggcatagatttacgtggtgtttgactaaggcatgcagaatataatcttgacataggctaagtttatcaacatagatacatagagattctaaagttaaagtcttagcccaagaagttagaagtggtgctcaagtttgtttgtctgacagaaactgtgaatccacactggcctgcttattttgaggttgcgttgccagagctttcctagcataataaagagaggtgcatacaaaggaataggaatagtaggaggtgggggtaaaaatatcaggtgtgatccacatgccaagccgacccccactgtgtcccacaggaagccccagaagatgtttctccaagaaattaggattcgtttgttggggagggctgctggcatgcttgaaaagtactgtgacggctgaattttgtgggcttggggagattgcaggttctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatctgactgttagggatctttgatgaaggctgattctcagggagtgaactagatcagtgaccaactatttgtctttatataactgggtagtgtggatggattctaataaagggactacttacagcacagcaggaaagtcacaaagaaaccagacagaagagtgtaagtagtaaggggccaagcagtcatctgactagagacagtgccagcttgccaaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccgcaacacccaagccatggaccagcaccggttcgtgtcctgttaggaactgggcacaaagcagtagatgagtggctggccagccgagcattactgcctgagctccgcctcctgtcagatcagcagcagcattagaccctcacaggagcgcaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacatagtacattgggagaccgaggggggcggatcacctgaggtcagaagttcgagaccagcctgaccaacatggagaaactccgtctgtactaaaaatacaaaattagctgggcatgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaaacaaagaaaaaaatatatatatattacaaaatttaaagagagtggtacaccagtaaaggacacttagcatgaacagaagttgcaggactggcagttgctctgatgagtcagtgagtacttggtgagtgaatgcgaaggcctaggatattactgtacataactatagactttatatgcactgtacacttaggctacactaaatgtatttaaattttttctttctttaacaagttcatcttagcttatcatgactttataaacttttaatttttttaattttttgattctttggtaataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggtcttcagggtcttcagtggcaataacatacatgcagctgtcattttctatgataacaaggctttcttctggaagaactcgtggaagaccttcctgaagctgttttatagttaattttttttaatgagtagcagtactacactctaaaaatatgaataaaatctatagtattatacatactgttgatccttgaacagtgcaagggttaggggaccagctcctctgcagttgaaaatccatatataattctgggatatccccaaacttaacttaatatatgatatatatcatatataatatatatgatatatattacatatgatatatatcatatatattatatatgatatatattatatataatatgtatgatatatattatacacaatatgtatgatatatattatacacaatatgtatgatatatattatacacaatatgtatgatatatattatacacaatatgtatgatatatattatatacaataagtatgatatatattatatacaatatgtatgatatatattatatacaacatatgatatataatatactatatgatagagattatatacaatatatatgatagagattatatacaatatatatgatacagattatatacaatatatatgatacagattatatacaatatatatgatacagattatatacaatatatatgatagattagatactatatatgatatagattatatacaatatatgatatagattatatacaatatatatgatatagactatatactatatatgatatagattatatactatatatgatataaatggtatatcatatatgatataaatggtatatcatatatgatatatacaatatatcgtatatatgatatagatgatatatcatctataagatatagatgatatatcatctataagatatagatgatatatcatctataagatatagatgatatatcatctataagatatagatgatatatcatacctgatataggtgatatatcatatatgatatagatgataaatcatatatgatatagatgatatatatcatatatgatatagatgatatatatcatatatgatatatcatatattatataataaatgatatatattatatataataaaagctatatattacataataaatgatatatattatgtaaaatatatgatatatattatatattatatctgatatatattatatattatatattatatattttatctgatatatattatatttgatatattatatattatattatatataattatattatattatattatattatatatattttatattatattatatataattatattatattatattatatattatatataatttatgatatatataatgtattatatataatttatgatatatattatatattataaatcatatatcatatatattatgctatattatatataatatagcataatatatcatatattatataatatataatataatataatataatataatgtaatcatatataatatataatatattatattataaaatatattatattatgatatactatatattacatattacattagataatattttatataatatataatatatattatatattatactttattatattacatatataattatacattatatttcatatataatttataattatatataattatatattatattatataatattatgtataatatattattaaatataatattatatattatattaaatataatattatatattatattaaatataatattatatattatattaaatataatattatatataaggatgcaggatgtaaaaggaaattatatatatgttatatattatatatattatattatatataattatatatatatttgggggtgccctatttcctatctcataacttattttaagaagcacagcataataatgtgtggacttgggattcagtttttgaaacgacacactgagccttccatgaccttcctgtacatgtgaaagcacacctgtctgcatggcagcatttggacctcacagtgtggattgtgccttcaccctggaatgtttatgccctatcgccatggtgatgtgattagggatctgctgcccttggtcctaagtgccactatctgtgctgagtttttcaaaggtcagagcagattgaacctttgtggttccattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattcttataccaagcagagtacctttgaaatttttcttcatttaaaaaatatgtatcttggctcaagcctgtaatcccagcactttgggaggccaaggcaagaggatcacaaggtgaggagatcaagaccatcctggccaatacggtgaaaccctgtctctactaaaaatacaaaaaattagccaggcatgatggcagctggtgtagtcccagtgtgaattgggattcagtttattcccaaattcccaaaatatatatatatatataatatatattatattatatataattttatatataatatatattatattatatataattttatatatatatatttgtcggtgccctatttcccatctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtcttgctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccattacagtgaaaccctgtctctactagaaatacaaaaaattagccaggcatggtggcagctggtgtagtcccagtgtgaattgggattcagtttattcagtttattcccaaattcccaaattatatatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacatctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgccttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagagctttgaaaacctgtttacttgttaatgctgttttgatgtattgtgtctttgttctcccgacccatcatccagagctctctgcaggagctaagtgctcatcagttccatgatttggaaactgtctaagtttagaggcacttgtatttgttagtaaataaggcaagatgatattgtttcacaggttttagtgcagaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaacattcacacataaacaaggcagaaccctataccctccatgataaatgcagtagcagtgtatgtgggtctgtggaggttgaaagggacttggtagatgtcaagaaggtagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagcaatgctgtgtccctccacatcccctaggtgactcgaagaagccttccaaaaagcgtgtgaaaaggaagccctactctactaccaaggtaaagtagcctgtctttgcctaagatgcaaatgttgttttcttggatcctttatttttcagttgatatcagctatgggaaaattatccactacattataggtgttagataatatttccttgggggtggaggaggtgtattttaccaactgacacctgattccagaggacgtgcaaaattggcagtgtcagatagtacactgggtgctaagggatgttttcttcaggaacaagctttccactttagataagaattctgcaatttctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctacgaaaaaaatgttgtgtttacccagcacaactctcagtgccatgtttcttaatttaacaaatcagaccacatactttacttacattagttcacacctcatcatcatcatgcccatatgttgtgagcttgtttactgagcccacatgccagatggagaaactaagccacataaataaatgtgccctggttcacttgctgcatagtgaagagtcaaaatgtttactcatacggtgctaatgttgaaggcctgaactacaacctctatttatcagccagtgaagagatcactattcaccatgcaagggagttccagcaccctctatgcctggaattacccacacctgcagagatcccaaacgccatccctcacataagagaacgtcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatggcacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagattggtcattttaggtcaaattttacccagagctggtgcagccactgcccattcttagccagaccttattgcaggcagctctgatcaatagtcaaggaggcagtgggggttgtagactttactcattaaatcaccaaagcaccagcccacacggccacttttccagttaattgacagtagcttgcacattcaggtttgatcagtggaagggaagttactctttgcagacccatttttgacaatcattttgcggtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcaccacctttgtccacccacacaccttgggctaggaggactggagaaagacagtgaggggtctcttgggtctctggcacagggcgtgatgaagagatggcagtttttcaggaatctctctctttagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctctataaaccataaggcgtcatgcccacggaaaagccgaacaggaaagcatgctccactgccccggagccatccaagttccccctccatattccgccactgctaagtgtccagcttattcctcctggcatgtagtaaacacttagagaacattactgaagtaccagtcctctctaaggttttcctgtatttagtgattttttagccctgtactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatcctgctgtgttcccctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgggcgtggtggctcacacttataatcccagcactttaggaggccaaggcaggcagatcatctgaggtcaggagttggagaccagcctggccaacatggtgaaaccccatctctactaaaaatccaaaaaaattagccgggtgtggtggcaggcgcctgtaatcccagctactcaggaggcggaggcaggagaatcgcttgaacccaggaggcagaggttgcagtgagccaagatcatgccattgcactccagcctgggtgacaagagtgaaactccatctcaaaattaataaataaataaataaataaataaataaataaaaattgagtatataatacaggaagttcccatattattctgtctcctcaccctcacttcctaatttcacctattagtaacatcttacattactgtggtacatttgctagaataatgagaaaatattgacacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattcaatgaatttttgtctttttattcacctgttgaagaattcggtagatttcatgagagaaaccatctgggcctggtgctttctttttcggaatgctcttaatgtgaattcaacttatttaatagacataagtttattcacattaggattctagcgtgaccttgggaagattgcctttcaaggaattgatacatttcactgaggttatcagactgcggtcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctgtagatttccctctaaggactgcttttgctacatccagaaatcttgccaagtcacattttcttttaatgtagttaaaagtatttttaattttctattgagacttcttaacccatgagttatttaaaagtgcattgctaatttgcaaatatttggggattttgtggctcttttacagttgttgattttttgttgtcaggtatgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaacggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaatcaaggaaaatgtaatagttttccataaattagaataccctacatgtacaattaaatgaaatggctagtatagtcttgaaaccaaaaccagataaggtaaattaaattctgtgatattttaaaatactttaaattctgactaatgtgagttaatctcaaaatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgttacaaccacttgaattaatgctgctttcacagcatatctcttggcttgttaaaaacccgacaagaatttccgtaacattatttttaacacctatattgggtgtgaacccaccataaagtttgcccactgaaaaggtctacaatttgatgctttattaaattgatactgtgtgcacccaacaccacgatctaatttaaatatgtttccctcacccaagttctgtcttgcgcactggcagttaatccccactcccatctccagccctaagcaatactgctgtgacattccatctccataaatttcccacttgctttatagaaatggacatatatatatatttggaatctgacttccttcatttagcatactatgtttgaagttaattgacgtgttagcacgtgctggtcatgtgttttccttcatagtctgctgtgtttattcatacaaatagtgtttattcatttatcagttaatggacatttaattgttttgttattttctttgatgagtaatgtagctttgagcattcacatacagtcatgtaatgcataatgacattttggtcaaaaaaaatttttttttttctgagacccaggctggagtgcagtggcacaatctcgggtcactggaacctccatctcccaggtttaagcaattctcatgcctcaacctcccgagtagctgggacaactggcacacaccaccacgcctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaacaccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatgtaacacattatttatcatttgaaccttttaaccaaagtgtgcactccgtggcattcaatatattcacagggttgcataaccaacaccactatctacacccacaattttgatgatttcttacaaaaccttgtccacaataagcaatatagcaccttccccctatttccagcccatggtgattcctatccgactttctcttgtatgaatttgactattctaggcacttcatgtaattacaattatacaatatattccttttgtgtctggcttatttcactaagcataatgttctcaatgtccacccatgttgtatcatctatcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttgttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcactgcagagttaaaacataccagcattcaacccatgtctcctgtcttgaagtaaactgtcgtatgttggctggcctgaacaagcgtagatattctccatcctcaattaatatgcatgcatgacaaagaaaaggaggcctggatgaaaaaatactgtgtgattaataattatgctttaattaattttaaaggatataatttcagtacttctaattctcccatcagcagttataacaaaggattagtgaataaataccatagactgttttgcctagaattgaatccaacctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaataactcatgaacaaaagcatctatgactaactgttgctctgtgtcctcctagcctctgaggagtctctagttcacaaggacagaggagatggagagaggccagtcaacgtgagggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatacaaaatggcatttagctatgatggcttcaggttgtagactgtatccttggggtccttgtccttggaagcaatgtcttctccttggattcagtattttgcacttgccaacctacgtggacctgagagatccaccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcatgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaaaagtgaaaacacgaacccaggagtgtgggccagtgctgacgctgacatgcacttagtcatggggtgttcaccaccacacagggagtccagcattcatgtataaaccctaaggcaccgagcccaaaaggccccaggcactgcccatcatcataaagtggtctccgtggtcacacaacccagggcagttataggttcatctccccacggacaggcatagtcatcagtgtgtcaaaagcacaaagatccccaggtgtttggctcagctcaccgatcctttttttttttttttttaacttttaagttcaggggtacatgtgcaggatgtgcaggtttgctacatatataaatgtgtgtcatgagagtttgttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgactggctagtgccgggtatggccaccagcccaactgaaacaaaatgttgctttaaaacaagtgtaaatctcatacatacaacaggcaaatgcagaagcagtgtggtctcgcaagttgtaaagaggacagtcgcaattttgctggacttcaacctgggtagaagacacgagggaactctgtcactaaatcacggcagagttcaaggccgcttgtagactatttcgtgttatagaaggtggcctttagctactaagcaaaggcctctgtttctcatttctttcctgttcatctccttggtcatccttcttccacaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatccttatgttggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgacaagggcaacgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccagggcatcgccaacgaggacgccgcccacggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaaagaggacgctgtacacgacatcgctaatgaggacaccatacaaggcattggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtataccacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacatcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctctatatgacatcgctaatgacacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcggcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggactttgacctttgactcaatcactataccccttcttattttctctctcaagttgtcgagagactatcagatctgtgtgacgtgtatggcatcatttcaccctcctaatgttttcttttctataattgcaggagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccacttaactgctcattgactcttactgtagatgaggaggtggccagcagcccctgccctcccccagttgtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtcaaatgccaataaaacaattgcctctataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacgtttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccgtttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcataaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgcactgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagaagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtactaaaaattctaatggctcatcccatttaggggctgaaagttgcagaggtttaggaagctcacccacgatactggagcccccatctcttgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcaactcctatagtattgaaatgcataggttagcatttttggccaatttactcagcattctgggttaaaggcttttatttattttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttacaaattattgtttacatttgaagtgttttatgaattaatatttaattgcatagatgaagattactagttataggcattttactaaccaatactcattaagcatagcatggattcatatgacatcaaggagctattttatttggtaaaacgaaaaagcacaagaatgaacgaatgcaagaactgaaacagtggagacacctagaatgacttgtctaagatctaaatcattttgttgtcttcccagcatacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaatcaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagccgttcgaagtatggcaaaatggaactttaaaacagtatcttgtcaacaaccaagaggacctgtttcacataaagcccatgcattcatctgcctgtccatcattctgtctgtccacacgggcatcattcgttagtggaactgagtgcccactgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccagatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctctacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccacccaggttggtgccggactctccctgggcccccctgttctctcaccagccacatccattctccccccagaggcgctagtgactgtgcgtggctttccattcccaccatgtttgtctctaaccccagtggcagatcagtgtaagaacacagctgagtgctcctcgcctccttgccccttcaagggctcctcaccacccaccagatcaggtgcaaacttccaagccttactggatccccttccacattctgagctccgcctgccttcccatcgctatccttccccacctgcctccctggtagagaaaagcagagtgtgtgatgctgtctgaatgctgagcacggccttttgcagccagtccactgtgtatgctgcccctatcggagacctccaccttaaccctttccagcctggaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgttgaataaatgaatagcagttacaaaacacttgattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcatcgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaagcttcatcagaaaacaatgcttcattaatccgtgacaggacaagcgtcagcaaacttccaggcggctggattaggccttcatctatccatcaccttggagaggaacaaaataggtggcctgggaagataagcactatgtttctattccttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgtgagccaccgtgcccagccttttgtttattttttgacgagacggttcttgctctgtcaccaggctggagtgcactggcacaataatagctcaccacagcctcgtgctcctgggctcaactgaccctcctgcctcagttttagcttcctgagtagctaggactacaggtgtgtaccaccatgcctagctataataatttttatttttttgtagagatggagtcttgctttgttgcccaggctggtcttgaagtcctggcttgaagtgatcctcctgcctcggcctcccaaattgccgggattaaaggtgggagatcgcacccagtctccaaccctctttttgcaagtaaatgtaactggaccccagccatgctcatctgcccatgtactgtctacggctgcttttgctctacagggcagagttaagtggttgcaacagacaccgcacagaccacaaagtctgaagtactttctctccagccctttacagagaaagtctgccaacctctaatctcaataacagggaaatcaatgacaaccacaaagtgacaaagactgggtgtctaagatggatgctcagaataaacaagagagaaagatgaaaagtagaaggaggatttcaaacgcaagcttcacctaatccgttatttttcaaatgaccaggcctatctctgtagctgaaaatcacctcaaataagatctctgatatacagtctccaaaagctcagccaagaaacttacaaagtctctctgccttaacttcatccaccttttttctctccagcttctcctcggtagttaatgattataaaaatatttattggctcatgcctgtaatcccagcactttgagaggccgaggcgggcagatcacgaggtcaggagatcgagaccatcctggctaacacggtgaaatcccgtctctactaaaaatacaaaaaattagccaggcgtggtggcgggcgcctgtaatcccagctactcaggaggctgaggcaggagaatggcatgtacccacaaggcggagcttgcaacgaggtgagatcccactactgcactccagcctgggcgacagagcaagactccatctcaaaacaaacaaacaaacaaacaaaaaaacagtgtgatggccaggcgcagtgctcatgcctataatccaagcactttgggaggctgaaatggatggatggcttgagcccagtagtttgagacaagcctggcaacatagcgagacctcatctctacaaacatctttaaaatatgccaggcatggtggtgcatgcctgtagtcccagctattcaggaagctgaggtgggaggatcacctgtgcccgggagttcaaggctgcagtgagctatgatcacaccacagtgctccagcctgggcaacaaagcaagactccatctctaaaaataaaataaaattaaaaaaaaaagatcttcgctgtaaaagaggtacactcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactcaggaggctgaggcaggagaatggcataaacccgggaggcagagcttgcagtgagcctagatagcaccactgccctccagcctgggtgacagagcgagactccgtctcaaaaaaaaaaaaaaaaaagaaaaagaaaagaaaagttcttgtgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccggctaatttttgtatttttagtagagatggagttttgccatattggtcaagctggtctcgaactcctgacgtcaggtgatcgacctgtcttagcctcccaaagtgctaggattacaggtgtacatttatttatttatttgagatggaatcttgctctgtatttattaatttatttatttgagatggagtcttgctccatcgcccaggctagagtgcagcggtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttatttaattatttagagacaaagtcttgctctgtcacccaggctggagtgcagtggcgccatctcagctcactgcagcctccgcctccgaggtttaagcaattctcatgcctcagcctcctgagtaactgggactacagatacttgccaccacgcagggatttttttttctattttttttgtagagacacagtttcaccatgttggccaggctggtctcgaactcctgaccttaggtgatctgacagcctcgtcctctcaaagcactgggattacaggcatgagccccttgcccggcctctcactacatttaagtgacgccatggctcatgcctgtaatcctagcactttgggaggccaaggcaggtggatcacctgaggtcaggagttcgacatgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaaagagagaaaaacatatgatgccagggcatctcggcctcaatacctgggtgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagagattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgaggccgggaattttgagaatagcctggacaacatagccagaccccatgtctacaaaataataataaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaataaataaaacatactgaaatatgtatgggtacagttatatatctgggatttgcactgaaataatgtggggtagagggaagcaggaaagagtatacatgaaatgagcttggccataagattgttgttgaaattgaatggatactctgggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggcgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagggaaggatgcatgttgtaagctctaaaataatccagtcatcttttaaaataactctaagactgcacagttatgaaactaatagagaaggaggaaattaaataataaaactaataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataagggtacagagaggtggaagatcatgaaaaatatgtcatgcatgtactaaccaagaaagctgtataactttttttttttttttttttttttttttggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatattagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagggacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagattgtgccattgcattccagcctgggcaacaagagcaaaactctgtctcaaaaaaaaaaaagaagttactagctagtttcggtaattcttaacatccaggaaactggatgtgaaagtttttcagagaaactaaaccaatagattatacatagagagagacttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggcagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtatttgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataaccattagaacaaaaatataaacttttctttctttttttttttttttttttgagaccaagtcttgctctgtcacccaggctggagtgcagtggtgcaatcttggcttactgcaacctttgcctcctgcgttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccaccccccttggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccgggtgccatgactcactcctgtaatgccagcactttgggtggccaaggcgggtgaatcaagagatagagaccatcctggccaacacggtgaaaccccgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcccaaaaaaaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttcgaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctggcgtcaaaccctcaaatcccctgagagccactggggagactaagcagtccccagcccccacttgtccctgagctgccattctcagccctgtgggaggagacagaaagccctgaagagaaaccaaaggaccaggtcaggaggggctgggggggtggcatgagcaatcagggcagggaaggatggaccgatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagtggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgggatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcaccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgcccaagacctgcaggtgctgaagcccacacacacggctcctgcttcctgggccagtgcacgtgcacacacacacacgtgcacacacacacacacacccacaaatatacccacacacaatcacacacattcacacatacccaccccccatactcacacacacatttacacacacccacacacccacactcacacactcacagtcacacacaccctcacacagcgaaacacaatcacacacattcacacccacccacaccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactgacacataatctctcacacacacacatgctcacacacacacgccttctccaggaggggctggctgccaaaggccacccagcttcctcccacgtctcactcaccgtacaatatttgagaagaccttggagtcagcagcaacagcggcgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggccccacctaccgcccgccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccccctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgcttctgcagcctggcctgggtcccccaactcccccagggtgaccaagggctttccagtctgcacagaggacagggggtcttgacagcatcaaattctggtgactacgagacacttacgtgggaaatgcagacagaccatgcctctagcccttggcaccaggcaccatccatccctgggacttgctgtcctggaaatgcagcatggtcctccagggaggggggctgtgccatgtgggggccccaccccacctgcagctctttcccaccctggctgcaggtctgcttccctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtgtacacctggagtctgggcccctccatctgggcagcagagaaactgaggcacagagacagactgtgtccttacagggcacacagcctgccaggcccctatgtccggccagagcccctggtcagcctgggctgcagtgattgtttagaggtaggctgttcccacggctgcctctcacggtaggggggcctgtggacgcctcctcccgcccccacccgactcccaagcctcagtgacattgctcaaccaggagctgaagtgcattcctgggctccggccagcccacccacccacccgctgcagtcctggaagcccagaggcctgggcagcaggaacagtggagacagcagtgtgggggacgtccccctcctctccccaccatcctcgtcaggcagaggccagggtgcagggaccaccggagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgctgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtattgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccatatgctgagtgcaggtcccctgggcccacttttctttctctatactttgtctctgtgtctctttcttttctcagtctcttgtcccagctgatgagaaacacccacaggtgtggaggggcaggccaccccttcaggtccctgaatgtccttcctcaggaaatgatgggggaaggggcgatgagaatgaaggagacgatttaagtccctcaccccccgaggtagtcctgggctgagccccatgggacctagagaaccagggtgtaccccaccagcatgtcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaattttttttaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttggaactgtgcacagaggagggagcaggccccgagggaggcctggaggggctgccaatggtgaaggctgctgtgtcgagctgtttccttccggacccactccctctgggctgcgtccccggctggtccaagccctgatccctgggatctggggacatcttcccgtttgctgttccctgagaaccaggcctccctgtggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgccttgctctccccatgctgaagatgctgaggctagttccagtgcccgcattgtgaagatctccgaatcccacctctctgttcctccccagccagatggctccatttcacacacaatacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcaatcagtagccagcaggttccccgcctttcctggagtccgaggcagctgcccagccaccagccgtgcggacgatggcttgcaccacagcgatgaaggtggatgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggctctcatgtcacaggggctccagatggcccaggcactagagagaggacaccaaccattgtccactctgtgatgatccaggcctccagcccaggatgccctgggaccccacaccgtgactcagtttctccaacccctggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagcgtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcgggcacatggacaagagcggctgcttccctgcggccgatgggagaagacagggatgcccgtcagctgcctgcccaggacacccgcccctctccaccccagtcccccaccccccagacctccaccccatacctggctggatgaaattggcaggtgaggggggtgccccaaactcattggtgaatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtagtaggagatcgggtgagtggtgtggtcagagatctgggaccggagctgggcagcgaagaactcagaggtcatgttgcggaccacctgctgagaccccagagctggcctgaggaggtggggagggagggtggggagggggcacaggtctcagaaggcccttgactgtgactctgaccgcaaccctctggcacccacaaccttccgtggctccccaggacccaagggcaggcccaagaccttgcatgaccagtctgactccctgtctctgtcgcgttccagcaactctgaatgtctgtctgcctggtcctcagcctccagacccttgccgcattcaatcactcattctttcatgcaaaaaatatttctacaatttgcactgcatgcctggcactggggaatcaacagggaacagacacttaggtcctgccctcatgccaagaaaaacaaacacacacagggaaagtgctgaaaccacaggccaggtaaggggaatcaagaggcatgaggtatgggcagagtggtcagggagggcttctcagaggaggcaacgtgtgaaaagagcctggaaagtggcctaaatggtcagtgcaaaggccctgaggcaggtggcataggctggtgagcgataggcagagagtgaatggagtagggtggggagaagaggatgaagatgcaggctggggcccatcccacaagacctcctaggtcccataacaactggcttttgctctgtgccatgcaggcttaggacagaggaatgagcaggctggggagtgttttcacagggtccctctggcagctatgacggggataaggataaagcccaaaggggaggctgtgggtatcaaccaggcaagagatgatggcctgggtgggagaaagagaagaagcctgtgcgttctgtccatgtgatgaggtgggctcctctcaatcttcacacagcacagctgagcctcaaacccagcactcaccctgacctctcacctccccacaaggtaggaaaacctgttgcccaggctggagtgcagtggcacgatcccggctcactacaacctctgcctcctgggttcaagcgattctcctgcctcggcctcccaagtagctgggactataggcgcccaccaccacgcctggctaatttttgtatttttaatagagacagggtttcactgtgttggccaggctggtcttgaactcctgacctcgggatccacccacctcggcctcccaaagtgctgggattacaggagtgagccaccgcatccagcccctatttctttttaagacacggtcatgattcattgcccaggctggagtgcagtggcacgatcacggctcacttcagcctcacactcctgggctcaagcaatcttcctgcctcaacctcttgagtagctgggactataggaatgccgcaccacacctggctaatttaaattttttttttttttttttgtagaggtctcactatattgcctaggctggtcttgaactcttgggttcaagcagtcctcccacctcagactcccaaagtgttgggattacagttgtgagcaaccatgcccaaccagattttatttttatttttatttttgagacagggtctcactgtatcacccaggctagagtacagtggtatgttcacggctcactgcagccttggcttcctgggctaagtaatcctcccactttagcctccctagtagctgggaccacaggcacacaccaccatgcccagctttttatgtttttatttttttattttttgtagagatgaagttttgccatgttgctcaggctggtctgaaactcctgggctcaagcgatctgcctgcctcagcctcccaaaatgtggggatttcaggggtgagtcaccacacctggcccagattttattatttaagttaacattttgttaccattgcttaaagccacctggtccttttcatcagatagtttcttacagccaggcacagtggctcacacctgtaatcccagcactctgggaggctgagacaggtgaattgcttgagccctggagtctgagaccagcctaggcaacacagtgcaaccatgtctctactaaaagttttggtctcgatctactgaccccgtgatccgcccgccttggccttccaaagtgctgggattacaggcgtgagccaccgcgccggcctaaatattttttttttaattagctgggtgtgattgaggctgggcactgtggctcacgcctgtaatcctagcactctgggaggcaggtggattgcctgagctcaggagttcaaggccagcctgggcaacatggcgaatcctcgtctctactaaaaatacaaaaaaaaaaaaaaaaaaaaaaaaaaaattggccaggtgcagtggctcacgcctgtaatcccagcactttgggaggccaaggcgggtggattacctgaggtcaagagttcaagaccagcctggccaacatggtgaaaccctatctctactaaaaaatacaaaaattagctgggtggtggcgggtgcctgtaatactgggtactcgggaggctgagacaggagaattgcttgaacccaggaggtagaggttgcagtgaaccgagatcacgccattgcactccagcctgggcaacaagagcgaaactccgtctcaaaaaaaattagctgggtatggtggcatgtgcctgtaatcccagctgctttgggggctgaggcatgagaattgcttgaaccggaaggcagaggttgcagtgagccaagatcgtgccactgcactccagcctgggcaacagagtaagattatccaaaaagaaaaaaaaaaattagcgggtgtggctacacctgtagtcccagctatgtgggaggctgaagtaggaggatcgcttgagtccaggtggtggaggctgcagtgagctatgattgtgtgaccgcactccagcctgggtgacagagccagaccctgtctcaaaaagaaaagggtcatgatgcctccccaacaggatatggtggggacgctccaagaccatgggagaagaggatacgagccggagctatggaagaagtgaacacgtaagactccagaggcaaactgcccgtctagacagctctggcctgcagagcccaccactcccaggccagcgccgtgaggtcctgttgagccacccacctcactgtgatcatccccaggtaaaccctcggacgtgggcccggtgccctccttgctgaggctgaagccacgtggccatgaaaacctgagcatcacaagccgctctctgcgtttgtggtgtgatcagggccttctaccacaagccatgtgcccaggctgatcctctctaatgtggagaggcggctgcgctggaaaggcctcagtaagagcagctgggcccttgcagacagacatcacggtgtgaccctcgggactggctccctgcggccactgcagcacaggtgttcacatctcacagtggaggcagtggagaccatgctcgcctgcaggctctcggcgaggctctgagtctggccccttgcgtagcccctggtgactccttggcttctggagcggaactccatccttcacatggcgctttcctcgagggcctgtgtgcgtgtcatctgtggccaagttcccacttcataaggacatcagtcatattggatggggtcccaccctgctccaatgagaccccatcttttttttttttttttttttgagacagagtcttgctctgtggcccaggagggagtgcagtggcacgatcttggctcactgcaagctccgcctcctgggttcacgccattcccctgcctcaacctcccaaggagctgggactacaggcgctcgccactgcacccggctaattttttgtattgttagtggagacggggtttcactgtgttagccaggatggtcttgatctcctgaccttgtgatccaccctcctcggcctcccaaagtgctgggattacaggcatgagccaccgcgcccggctgagaccccatcttaatcacacctgcagtgaccctgttttcaagttaaggccacattctgaggtattgaaaattaggactccaatatgaattcggggggacccaatttaacctgtaatatgtatatcccaaatgcaattttctccttttttcttttagacagttgctctgtcacccaggctggagtgtagctcttggctcactgcctctgcttcccgggctcccgcaatcctccacctcagcctcctgagtagctgggaccacaggcgcacaccaccacacccagctaatttttgtatttttgagagagatgaggttatgccatgttgcccagactggtcttgaactcctgagctcaagagatgcactcacctcaacctcccaaagtgctgggattacaggtatgagccagcatgcctggcctccaaatgaaattttcagaaaggccttttcataatagtaacgggaaacaagtgacataggcatagccttgataaatgtgccaaaagcccatttggaaatagcacatttgtaggaggcctgaggcaagacttgtgggattggacgggaatgctctgttcctgggaccaatacctgatgatggagagtgtccattcttccctttaaaatttttattttaatattttatttttaaaaaggggtcttgctatgttgccctggctggtctggaagtcctaggatcaagtggtcctcccaccttggcctcccaaagtgctgggattacaggtgtgagccactgtgcccagcccattcttcccttttaatatatacgcttcacatacaggctttgtttttgcaactcctatcaaatcccaacaatgtatttgggagaatttgacaagacagttctaaagtttatctgaaagagaagcagcagatcctaaatggctttccccaggcccagcactggcagatagcacctttctaaccttcgggtgtgaatccaagggtggtggtggagcttcaggacacatgcaccctcgtgtccctcctctatgtaaatggaagccttcagtgccagctcctttaggttgtaaggactgaacacgctcacagaagtcgtgtgcacagtgaggtgggggctgaaatgcagcagctcctctccctgtgttctgtccccgccccacctctcccccacctcaactttgaccactaggggaccaattataacatgagatggcaagaatagctcatgtaaagccaccccaccccagtcacctggttgctgcatagtgtcacattcataggagtacaatttagtcactagtaatcctttgcgaataatacaaacgtccagtaattctttgctgcataacaggccttgtgctcaaaaggttctgcagaccttgcctgggtgctctggccaagctgcagtcatcccagggctggctgggggctgggggtttgccggcatgcctgctggttggtgctgctgccagtcccagctactcgggaggcggaggtacggggacggcttggtctcaggaggttaaggccgcagtgagccatgatcgtgctattgcactctggcctgggcaaccaagcaagactctgtctcagaaaaaaaaaaaaaataagggggtgagaggggctataaaggctctgaggtccacgctctggaggcccacaaagtcttttctgcatcatcttgtttgtcagagcaagacccaagggtgagcctagattcctgagctggggaaacaggctccacctactggtggtgagaactgtagacaatctgtggtcgttttgagtccactataagtaaccaaaataccttcagtcttgcttgcatttctcaacattagtgaaaggggacccagtgcttggttgtagcaggcgtcctaaactctccttctgacctgcagagttttcatctgcagaatgtcccctcctggtgcacagcattcatgtcccttgtcctcatccctggtgggtgctctcgccgcctcctttctgatcccatcctcctccttgtcctaccaaccgtctgtactcaccctgtgtatttagtttatataaatgttaatgcctggccagccgtggtggctcacgcctgtaatcccagcactctgggaggctgaggcgggcggatcacctgaggtcagaagttcgagaccagcctggccaacatggtgaaaccccgtttctactaaaaatacaaaaaattagctgggcatggtggcgagtgcctgtaatcccaactactcgggagactgaggcaggagaattgcttgaaccctggaggcggaggttgcggtgagctgagatcataccattgcactccagcttgggccacaagagtgaaactctgtctcaaaaataaaaaaattaaaaataaatgttaacacctgtagtcccagtgctttgggaggtcaaggcaggaggatcactttagcacaggaggtcgaggctgcagtgagctgggatggcgctactgctcctcagcccgggcaacagagtgagactcgatctcaaaaaaaaaaaaaaaaaaaaagaccagcgggggtggttcatgcctgtaatcccagcattttgggaggccaaggtgagtggatcacttgagcccaggagtttgagaccagcctggtcaacatagtgagacttcatttctacaaaaaaataatcagccatgctgtagtcccagctactgggggtgctgaggtgggaggattccttgagcccaggatttcaagaccgcagtgagctaggatcaagccactgaagttcagcctgggtgacagagcaagatcctttctctctaacaaaaaattaaaattaaaaaatattggccaggtgtggtggctcacgcctgtaatcccagtaactttgggaggctgaggcaggtggatcattcgaggtcaggagttcgagaccagcctgaccaacataatgaaaccctatctctactgaaaatacaaggattagccagacgtggtggtgggcgtctgtagtccagctacttgagaggctgaggcaggagaatcacttgaaccaccacgcccaacctaatttttttgttgttgttgttgttagtagaggcagggtttcaccatgttggccaggctcatcttgaactcctgacctcaagtgatccacctgcctcagcctcccaaagtgctgggattacaggtgtgagccaccgcgcccgatctgaagacatttttgattggttgattgagttgggggtctcactgttgcccaggctggagtgtggtggcatgattatagctcactgcagccttaaactcccaagcccaagagatcctcccagctcagccttctgagtaaccgggactacaggtgcacaccagcacacccagctcattttaaattttttctttttttttgagatggatcttgctctgtcacccaggctggagtgcagtggcgcaagctccgctcactgcaagctccgcctcccgggtttatgccattatccagcctcagcctcccgagtagctgggactataggcacccgccaccacgcccggctaattttttgtatttttagtagagacggggtttcaccgtgttagccaggatggcctcgatcaggagatcgtccatcttggccttccaaagtgccgggattgcaggcgtgagccaccgcgcccggccccgtagtttcttacatgttcacaaagagacaaacttaaaagagcaaagcattacgaactttaagaggccagtgcaggaggatcacttgtagctagaattttgagaccatccagggcaacaaagtgagactctgtccctacaaaaaaaattttttttttttttttttttgagacagactctcgctctgtcgcccaggctagagtgcagtggcgtgatcttggctcattgcaacctccgcctcccgggttcacgccattctcctgcctcagcctcccgggtagctgggattacaggcactcgcgaccatgcccagctaattttgtatttttagtagaaatggggtttcaccgtgttagccaggatggtcttgatctcctgacctcgtgatctgccctcctttgcctcccaaagtgctgggattacaggcatgaaccaccgtggccagcctcttttactatttttttttttttttttttaagatggaggctcacactgttgcccaggctggagtgcggtggcacgatctcggctcactgcaacctccgcctcctggttttatgcgattctcctgcctcagcctcctgagtagctgggattataggccaccatgcccagctaattttttgtatttttagtagaggtggggttttaccatgttggccaggctggtctcaaactccagacctcaggtgatccacccaccttggcctcccaaagtgctgggattacaggtgtgaaccactgtgcttggcctttactactacatttttttttttttttgagatggagcctccctctgtcaccaggctggagtgcagtggtgcaatctcggctcactgtaacctctgcctctcgggttcgattcccctgcctcggcctcccgagtagctgggactacaggcaagcaccaccatacccggctaacttttttttttgtatttttagtaaagacaagatttcaccatcttggccaagctggtcttgaactcctgatctcatgatccacccgcctcggcctcccaaagtgctgggattacaggcgtgagccaccgtgcccggccgtctactacttcttaaagggtgagaggcggaaggatcacttgagccctgaagtgtgcgactgcagttagcttttatcgtaccactgcactccagccagggtgacagcaggaccctgactctaaaaaaaaaaaaaaaaagcaaaaaaaagcatatactattaatacttcctccttactataatgtttactgtggcctttatcagactagagagtgcttttatctctcccttttgttagagcttttagaattatcaatagatggtcaggtgaggtggctcaggcctgtaatcccagcactttgggaggccgaggtgggtggatcacgaggtcaggagttgaagaccagcttggccaagatggtgaaaccctgtctctactaaaaatacaaaaaaattagctgggcgtggtggcgagtgcctgtaatgccagctactctggaggctggggcagagaattgcttgaacccagtaggcggaggttgcagtgagccaagattgtgccactgcactccagcctgggcaacagaatgagactctgtctcagaaaaaaaaaaaattattaatagatggtgaccctcatcttcatgttttctgcatctattgaagtgcgccattgagatcgtggagttcttccctgtttgtccatatggtgaacaacactgattttctgatgttgaacaatctctggaataaactctgtttggtttccatggatttctgtttccctttagattttgttagtaatgtattttggatttttgcatccaagttcataattgtaactggacaaataaaggcagattttaaaaggacaagttgggaggctaaggcggaaggatcacttgagcctgggagattgaagctgcagctagcctcgattgctccactgtactccagcctggtgacagcaggacctgcctctaaaataataatacttaaaaggacgagtttacctacagtctcaccaagcaatgaaagagcttatcttcctcctgtttcctttacggatcttgctcatgtattttatcttagttactttagcataaatgctaaatcaaattctttttcactagacatcatcatagctctaggcataccacataatacccaagcacattttaatcattaaaattgtttcctttttttgtggctactgtaaccacttcagcgaaccatttagtgtgtagtgggtttaaattattttttctcctttctgggataaatttcccaggagaaggataattgggtcaaaagctacgaacatatttatgggttcttttccacaagagatcgatcagtttgcaagtgccatctgcagtgtgggggaaccaatcttcaacttgcctgcatttggtattagtattttattaacctttcattgatccaattacggctctttgacacaattttcatcagtgatggactaagtgtgatccggcctgacccgcctccggccggcgtgagaaggggcatgtgtcgggctacgctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggaggtgcgcggggaacgccgctcttctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctagaatggggctggacccagggtggggtgaggcagggcgggcggaagggggcgggatccgggggtggggtgaggtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgtctccccgtccctgtctcccctgacactcgttcctccagaagcccggtaaaccccgcccttacaagccccgcccctagctcttctacggaggggaaccgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcgggggatgtgggcggagcacaatcgcatgggggcggggctctgagggctagaataggggcggagcgcggagggggcgtggccatgaccagttggggcgttgcttacgactggtcctgaggacgcgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgacgccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcctgcgggcgcggcggggcactgtggggccgggctgggctcccacctgcatgcctgtccccgcaggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggtgagccgggcggtgggcgcggccgcggtcccccacctgcccgcctttcgccccgcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccatattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccaccttggcctccccaaagtgctgggattacaggcatgagccaccgtgcctggccaacattttctccagatatcttactgagtcctaatttccactgtggccagagaatacactctgcatgattttaattctatctcatttactgagacttgttttgtggcccagcacaaagcttgtaatgaacactgagaagaaagtgtattgttgctgttgacagagtgattttttttttttgagacggagtctcgctctgtcgccaggctggagtacagtggtgtgcaatctcggctcactccaacctccacctactaggttcaagtgattgtcctgcctcagcctcctgagtagctgggactacagatgcattccaccatgcccagctaatttttgtatttttagcagagacagggtttcaccgtgttggccaggatggtcttgatctcttgacattgtgatccgcctggcttggcctcccgaagtgctgggattacaggcatgagccaccgtgccaggccgacagagtgtgttctaaatacccagcaggtccaggtgagtgacaggcttgttcagggctcctgtgtttactttcttgttggtagcgccgtcaattgcttattgtgaaatgccccttcataaacacccatacacattttgattatggatggccagtcttttttctatctgttattttcatcttacatctgtcttcatatgtaaagtgctttggttataatcagcacataactgggtctcacttcttcaattcatgtttgtaatccctgacttttaaattgggctggtaagtctattatgtttctccttttctgccttcttttggattagtatcttttaaaactccttttaacttatacgctgactcatattttttattaagacagtctcactctgtcatccagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtgtttttcaactctggaaatcccattagaagttgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagacaggttgcagtgagcagagatcacgccactgcactccagcctgggcgacagagtgagactccgactaaaaaaaaaagaaaaagttgactggagcttttcattcaactcttctttttttttttttttttgaccgttacccaggctggactgcagtggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttgaaaacaagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattatgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataaaacaggtagggaatatgtccagtgcaaacagaggactcacacctgtgcatagacagcaccatccactgattgtcgctgcagtccacggcgttactaagcctgcgccacccacgtgctgccccaggaggcgctaccaggctcttcgggccacaggcctctcctccactgcatgtggcggcagggcgggtaggtcgcagggctccatgattgtggggcagcttcaagggcacatggggcagaggccctcgaaggtcccctcctcagtaggggatgtcattctgatagtactggatcatgttgtaggtccggctcctgaaaggccaagaagagtgaagggagattcgaggagccagcagggtctggggtccctccctgcagggagccctacctgtccaatcagccccttatggctgcccagcacctgaaggtacaaatgtcccaggcgtgccctcccccacccagtgaccacatctgctccaacccgggggactctgaggccacctcatgctcctcagccaaaccgcttccatccgtgggagccactgctctgccccatgggcctcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgacggacctgggcgccacctgggggcaggtctcagcttcctctcacgctcctccggcagttccccatgcagatggccacacctgggcccctcctcctagtctggatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagttcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctggagaagaggctgtgtcagggctgccatgggcagggccgtgctggctccctggcccagtgggaggagggtcttccatggggacggacttcagctgagagccatgccctggaaatgtacctttggggtccacatgttggaagatggggtgctgtgaaggccacacctggcctatcatgggccctgtccccttcccagcatcacctgagtggccccatggcattaggggactaagcattggggagctaagctactgcagccccagaccttagggtggaggtggggtgggcgtagcatccttgacataaatagaggcccctgggtgggtctctggtgtggccggcacaagcaggggcccctcacagttgtggtctaggggtagagcctcacctaggaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagaacttgattgtctggccgcgaaaacagggcaggcccgtgtccaacatgatagtgaccagggagacgaccacatccatgtagggcctggggagagacaggagggagcggtgggcagaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggattgtggggaaggtggttggaattagatgcccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggtcctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactctgcaacaggagcaccccctccacccccaaaaggcaggttgtgttttcttggagacagtgatggggtgggtggtggggcagcaggcagagaaagagaagggaggaagtggaggaaggagccaagctggggcactgaacctggacgagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcaggcctgtgcagagagcgccctgggctcaaaaaggccctggggcctgtgggcattctccctggtcccacacccaggatccctgggcctgtgggcactctccctggctctgtgcccccactatggaggcagagcccgaatcagcaagtcagtcttcggcagcaggagtgacgggctgtctggatgtgggggtgcaggcacttcctcccacactcagaacttaactttcttctaaggagtccagcccagctctacattcttttgactcccaaagtggcttacagatgccctggtgtttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcgggatggtctcgatctcttgacctcatgatctgcccgccttggcctcccaaagtgctggcattacaggcgtgagcactgcgcccggccaggtgccctggttttttttttttttttttttttcagatggagtctcactctgttgcccaggctggagtgcagtggtgcaatctcggctcacagcaacctctgcctcctgggttcaagcgattctcctgcctcagcttcctgagtagctgggactgcaggcgcgtgccactatgcccagctaatttttgtatttttagtagagacagcgttcaccattttggccaggatggttttgatctcttgacctcgtgatctgcccgcctcggcctcccaaagtgctaggattacaggcgtgagccaccgtgcccagcccaggtgccctggttttaacccttaacaaaggatgactgaggagagcagggtgtgggtagaggctgggtatgggtggctggggtagggtggagcgcacacgactttccccggcctgtggccaccctggctacctgctggaaggccagagtggactcatccccgtactggcgtgtgaagtagtcgtacatgccaaagtctgtctggcggcccagctggtcccgggaggtgcagtcggggatgcactcgatcaccccgcactaggaggaaaggccagttctgaggcccgccgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagtagctcttctggctcatgcagggcaaaagccgagaacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcagggacagtgggaaaggggctggaaggagaggcctctgggttttgcagaagccctaatttaccccgtggcacctgaaccatgtaagagaaggaaaagattcacatttctgcatatgagattggactctggtgggcctggagccttggggagcagcaagcccagtccccaagcctacttgaggcctgaccctgcttacctgccggcagtcgtctcccagtttgaagatggctgcctgccaggagatcttctggccgtcggcctcctgcgtgctgcactcatcctcagagtctgagcggcaccgcagacctgcccgcagggagagaggccactgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgagtcagtgttgggtgctgtgagctggggggcaggaggaatgtgtctgtacactggggtcctgggagggctcggggccagtgtgcagacatggccatgggaggcaggtccctgcaaggggtggcagccccctctccacagctggccacaccgtctgtactgggttgaagagtgtctccctaaaattcatgttcaccccaaaccttagaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggtgagcccaggactgctggcaacaccaccagaagctgaggaggcaaggtgtgacctgcccagagccttcagagggggcacgaccctgatgatggactccagcctccagaactgagatcgtccgtacagtagccccaggaaactaacaccccccaacggccccgggcccctcagcctcaggaaggagcctgctggagcatgccagctgactcatggcagacagacctctggggtggcacatctgtcagtgcatttgagctccctgccatcccctagcgaggggtctgactgagggcagacagatggacagacatcatcttttatggagagctgtactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcacacgcggacgctgtggaagcgggggatgggtagggtgaggcgctcacctctacatcggggtcccagacttgtagtcgacgtccagcacaatggcttcagggttgctgggcagggagcagcctgtgcagggacagaggcagtcacagggagtgcatgtgtcaccacaggtgagccagagtcagtttccaacacggatgttacgtgcgtgtccaccctgcaggcacaccccacccctgtggaggggcctctggtccttgtccagggcaccactaacttattattctgtggccgctaagggtccgtcctccttgactcttcgactcttccaaccatcgaccaaatgagtctgcaccttctgggaaatgctcttcctagaggagcactgagccccatcctcacggatacagccctactgcttctgggggtgtgtgtgaggcctgtcctgcctccacctgcctgagcaacagcctctgaacagccctccattcttggagtccctgtttttttttttttttttttttttttggatagagtctcactctatcacccaggctggagtgcagtggtgcgatcttggctcactgcaacctccgcctcccaggttcaagcaattcttctgcctcagcctcctgagtagctgggattataggtgcctgccaccatgcctggctaatttttatatttttagtagagatggagtttcgccatgttggccaggctggtctcaaactcctgacctcaagtgatccacccgtcttggtctcccaagtgctgggattacaggtgtgagccaccacgcccggccttccttacccatttgaacactactctctcaaaagccttacttaaatgtcactatgtccatgaactgtccttggttctcccagcctttaggacttttgtctaacacgtttctttttttctttttctttttgagacggagtcctactctgtcgcccaggctggagtgcagtggctcggtctcggctcactgcaacctacgcctcccaggttcaagcgattctcctgcctcagcctcccgagtagctggaattacaggcgcccgccaccgcgcctggctaatttgtgtacttttagttgagatggggtttcaccaagttggccaggctggtctggaactccttacctcaggtgatccacccgccttggcctcccaaagtgctgggattaaggcatgagccaccgtgccaggccaacattgtttctttatgcttattttatatctctgtgagttcaagcttcttcagctcagggaccatgtcttactcatctttttaacagccacaatacccaatgtcatgccttttcttttcttgtttttgcttttttgagacagagtctcactctgtcacccaggctggagttcagtggtgcgatctcggctcactgcaacctccacctcctgggttcaagtgattcttgttctcagcctcccaagtagctgggattacaggcacgcgtcaccatgcctggttaattttttttttttgagaccgagtgtcgcactgtcatccaggctggagtgcagtggcgcaatcttggctcactgcaagctctgcctcccgggttcacgccattctcctgcctcagcctctcgagtagctgggactacaggcgcccgccaccacacccggctgattttttgtatttttggtagagacggggtttcaccgtgttagccaggatggtcttgatctcctgacctcaggtgatccacctgccttgacctcccaaagtgctgggattacaggcatgagccaccgcgcccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttctgcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccaatgcgggaacagaggccctgcatacatgtcctgccctctctgggaagccgtgctgttgtgtgagctcaatacaatgtgttgggaagaaatggttaaaccggggtcctgcagggcactcaaggaccagccgctgtgaacatctgcacgggacagacagagtttggaagacaagtttgtgccaatagttagaaatgcagagagaggccgggcacagtggctcatgcctgtaatcctagcactttgggaggccgaggcgagaggatcacaaggtcaggagattgaggccatcctggctaacacggtgaaaccctgactctactaaaaatacaaaaaaattagccgggtgtggtggcgggcgcctgtagtcccagctactcgggaggctgaggcgacagagcaagactccatcgcaaaaaaaaaaaaaaagaaatggagagagagctgcccagtgaagtctggatttccatcttctcttgaaaagctcggcttgaattcccatgtggccacagccacaggcacccaggagcgacttcccatggaggcggtgagggggtggtgctgatgggtcccagcacacctgagccctcccacactgggcccgccatccccttgtctgtgtgacctgctcctgtaatgctggagcctaggaaccctcttctagagtaacagctactgaggtcagtgtgagcctccagaaaaacagcaggcagcaaggaagatgaagggcacccactgacgagcagctcccgctcactagcggcagattttggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacctggctgcaccgtcacttcagacagggccgacagacaagccttctttctctggtcgcctttagggtagggcctgagaaacaggaaagaaattcttgctttgtctcctggaggaactggctactgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcttgggttagaagctgccagcactgctattctcagcacccagcccagaaaagggcctcaaagtgaccaaggtcagagcagtgtacgcaatggagacagcccagccggcgtgcccagcattgatgactccagggtttcatcccttatgaatgcacaaagccaccaacatccaaggatggtgtcaggtccacatgaatggaaggtctaggaaaacgatgacaggagctgcaaaggcagtctggttttcctgacaccaagaggatcgatccttcagagtgtggagagggcagggtgacctcaaattgtggagccatgtgctaaattccacaaatctcaggaatgaaactaagctgtgtttcctgaaactggcgtggccgtgcattctgccataccttcaagagccctgactcaccccaagcagtgcttccccacccaccctggctgtccatcagaaccaccagcagccccgctgctagagactctcattcatctggttggggccacgcacgggtatttttaaagcttcccaggcaattctgttaagctgcagggactggaacaagattccagaaggtggtttccgaagcactgcacttacttgatgacagccgacacgttggtgatcttgttaaagaaatcaaactcccgctggtaaaagtccttcgctgggcccgacaaggagcctgtgttctcctctactaactgctcccggaggtcgccgatgtcagctgccaaggaaacaaagaggctgagtctctgtggctgtggcagaggcccctcaggaataccagccctgtttcccaggccccagactggcggtgcccagagtatgctctgcaggcttggtgagaccataacagctgctgtgtgccccttttgctgtgttgacacagccgacactgctgggaagctaagctggtgcctaagcggagctcaaggtaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttttaatagaggcacacagtgggcggggctctatattaaatagtgtctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaacgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaatagcttcccttaaaaactctttctgggccgggcgcggtggctcatgcctgtaatctcagcacttcaggaggctgaggcgggcggatcagaaggtctcagccaggcaatgtggcccacacctgtaatcccagcactttaggaggccgaggtgggcggatcagaaggtctcagccaggcaatgtggcccacacctgtaatcccagcactttaggaggctgaggcgggcggatcagaaggtcaggagtttgagaccagcctggccaacatggtgaagccccgtctctactaaaaaataaaaaaattggccgggcacggtggctcatgcctgtaatcctggcaatttgggaggctgaggtgggcggatcacgaggtcaggagattgagaccatcctggctaacacagtgaaaccccatctctactaaaaatacaaaaaattagccgggtgtggtagcgagcgcctgtagtctcagctactcgggaggctgaagcaggagaatggtgtgaacccgggaggcggagcttgcagtgagcggagactgcgccactgcattccagcctgggcgacagagcgagactccgtctcaaaaaaaaaaaatttaaaaaaaagtccgggtgcggtggctcacgcctgtaataccagcactttgggaggccaaggcgggcggatcacgaggtcaggaggtcgagaccatcctggctaacacggtgaaaccccgtctctactaaaaaaatacaaaaaattaggcgggcgtggtggcgggcgcctgtagtcccagctacttgggaggctgaggcaggagaatggcatgtacccgggaggcagaggttgcagtgagccgagattgtgccactgcactccagcctgggcgacagagtgagactgtctctcaaaaaaaaaagaaagccctctctcgtctctcagtctgtgcttagtaatcagctaggcgctgagagaacagggcatggcctccttacagaggtttgctgcttctttgcgtggcatgttttcatttggcattcccttccctggaatgctctgccctgtccaccctgcatgccggtgcagcctttcagactcagctcaactgtctcttttccagaaaaccatctctgattccccaactctggatgggccaagtgtctgtaccggaggactgctcccacagttccctcaaattgaaatcacctgtccatttgactgcctcctacaagacaacaacagaccataccccagtcatgtaggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagtcaaggccagggctcaggggggtctaactgcttttccgtccctacctctggcaccctcagggctgcccacgttgcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtaggaaactttgggggacagcttcaaacaaccataagaggacaacggctgagtgtctggagtcagggactagaggccagtcacacaaagcagtgagaaggtgatgcagacaatttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtctggggcgatggagcacttggaggggctgggccgtccctggatgccgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccggtcagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacatgccggttcatgctccccttggccccaccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttggtcggggaacaggcacgtacgtcgatccagatgtagtggggggtcacttcggggggacagggtttgggttgacttgcttccgaggcagccagggggtctgcttcctttatctcagcagaaaacaggccaaatttctgctccactgtcatgtgccagcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgcattctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggctgctgagctggcaagggcagaagagggttctggatccagggcctggctcctcctctccaccccacacagaccctacccgataccttcatcccgctaaccagattaggaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtacccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccctttgcactctgtccttgtcttccttcctgctgggaggcacagaagccatctggaggctgtgagggtggagacaaaggccacataagcccaggatggccaggagccgacaggagcctggggcggggctctgtctgctgcttccctctaagctgcccatggggtgaggactcctgggggacgaggcactacagcctgctttgtgtttcctgcagaccgattagtcttatggaagcagacaagggagcaaaaaaatggcggtgggggggaccccagaactgccacggacaagaagccatcgaagagacacactcccatctatttgttaaacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtggccaggtggccagggagagccctggcaaggaggggacatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcgaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagggggcagcagctgggatgctgggacttgtcagatcctggataaacctcaaaggtgaaggtgatgggatgtgctgagagtcatcagtgggatgtgcataagagggagtcaaagatgtctgagcagagagaaggacctcgctggcatctacagtgaagggagggacctcgctggcatctacagtgaatggagggacctcgctggcatctatagtgaagggaagggtcacgctggcatctacagtaaagggagggacctagctggcatctacagtgacgggagggacctcgctcacatctacagtaaagggaggggccacactggcatctacagtaaagggaggggccccactggcatcaacagtgaagggaagaaccaccctggcatcaacagtgatggcggatgggcgaccagtgcagcggtgtctggagctgaggtcggacccattagttggggctgctaatcagttcaccatgcaggccgtgggccaagccactgaagggatccacctggactaggagtgactgggctgggtaagcagtggagctggccagagtagccaggcagggaggaggagccctggggcatgccagtactgagaaggccctgagctcaagaaggtccctttattctggaggatgaaagggctacaaaaattacaaaggccttaagtccctgggaaaagcagttaggctcccaaaacagctgctttcaagacccagaactctgaaggaggctgtgagcagctttccctgagctgatctgtcctcctaccatctgggacctgctagtgatatctgtactccaactgccctgcccccaggggtcaaccaacccactcctatctgaggacccactcctatctgaggaccagacagagaggccagaggttcaagggcacctggactaaggaagtggagaggagagagacagatctgggctccagagccccaggtacaatgtgagggctgacacgtggtcaggagcacccccagtgccctgtgaaatgggaacggctacagcccctactctttttcttttttttttgagacggagtttcgctcttgctgcccaggctggagtgcaatggtgcgatcttggctcaccgcaacctccgcctcctgggttcaagcgattctcctgcctcagcctcctaagtagctgggattacaggcacatgccaccacacccggctaattttgtatatttagtagagacagggtttctccatattggtcaggctggtctcgatctcccgacctcaggtgacccacccgcctctgcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggctttctggtgaccccagaaaacatcagtgccggctctgccagcacccagacacctggtaccccgagactggcaaggggactggaagagggcagtggcctccaggctccctccacactgcccagtgctgtgtgcacacaaaggaccacgggtcagacagatagaggccgagctgtggggctgtgtgccacccagaaactccggggaaaggggccagtggcggtcccccctcccctgcgcctcaccagagtgccaagggcccagacaccatgtgagcagcagccagcggggcgggggggcctcctgagcccgtggccttcctgggggtgcatcaatgcctggtcacctggggaagagaagacgaacacagtcacccagacagccatcagcgaagaagggagggaagggcgatgaagggacgcacctgggggtctctggctggggcaccaggggcagcccagcaggagactgtgaccacagagcctggtagttggatctgacagccaggaagagtaaggaccagcgaacaggtctagggagttcggtgggtgcaatacctgcccctctaacacaggacattaaggacacccaggggccacctaggccagggggcgctggtggcagacacacaattcttggcctgcgggtgtggtagcaggaggcctgggcagggcccttcccaagctggccacatttacataacaaaaggtcaaaattggagccacttgtgcaagggctatttataagaaccagtctcaaccgcttttggctcccccgttccttcccttcctgatctgctctcaccgcctccctgcccagagggcccagccccctagcccgcctggcctgaccacatggccttccctctccagaggtttcactgcctaagggctcacccaagctgcaggcctgggctttcaataccggcccaccaaagccttgggcagctgccgccaggaaacgaggggttccctcccacccccagagctctgggtcctgcaggaggggggatcctgaggtggtgggtccttgcaccccacacctgccagcctgggcccccacggaatagagccggggtcggggaaggggcgtgcagcggcccgtccccgtttccccttcccccactccacccccagggccagggaggctcagcaggtccctcaggaatgtgaccagacccggggtgccggcccagagctgggaggcctaggctgcagctggccagctgtctctccagcccctagtgcagctcccctctgggtggggggtgtgaggggagggggtgcatggctggtccaggaccccaccaaaggcccagagggcagcagaaccagctctgttggtaggaagcccaagggcgtccacagttagcaagggttgggcccagtgggctaatgctgggatgaggccagtagggcaggggccactgaaacactggcgggagcagtcgaaaaactgggtagagggtctcggtggcacactggaggcaatcagataccaccatccagccctgtgccacttcatctgctccccaaccactgcccctcaggacccagtcaaccatgggtagagcgcatgccaaactctgcagccaggggtcacctgaccttgccagaggccaggccagctactggatgccgcgcagggagtgggtggcagaataggactggggggcacctgagtgccatgggggtgggaacaccctccgtcagtgcccactgcctggccctgtcgggcactttacaagcccaaggctagcactaggtctccccaccaaggaaggatggccccaggctgggtcagctgtgatgtagaacagggcagggctcctccctgaaccctccacttgagttagggggtgtcagagccacctgcagaaagttcacagcaagcacaatgccaccatgcgtgccatccacaccagctgggccaagtctgggccacatctaggccgccactgtgtctgcgagcagcaatgcagcctcaccccatggcggggcagggggtggcacacgccatcctgctgcgaaacgcctactaagcactgctccttccttctcagccacagagctctgccctacccgctcaccgctggacatgaaacagcaagtgcctatcctggagggctccgcctggggagtgccaggtaactagaaacacggctctgggtgctggcccggatgctggtgctcagccctggaagcagctgactgcaggctgcgatgagaatgccacctagcacccagcagcccctggcagcaggcccgggcagcacgcctatcagcccccaggctagcacgcccagccctggcctactgcccatccagaaacgctggctcccaggacgcccaggatctgaggcagtagggcagcaggcctgggctatcggggccagctgggcattcgcctaaggctgtgacccatcccctccctaggacagagccttcaggggtccaggggagaggcaagaagggtagcacagaaactatctcccaagttaggatccctcagctccaggattccccctgtaggtggactggccccagctgggaaggacaagagccccagcagctggagggagggccagctctctctgcggaatcctgaaggtctgcaggaaggaacacaaagcctcggggttaccttcccaggccatctgttagagcagacacacggccctgtttacggaacagccaacatgccaactgctctcctttccttcccctcccagtccccgccacaaaaaagccagaaagccatgtccccagacactgagggcaggcccagggcccaggcaggtgctagcgggctggaacagcactcagatactccagcctctcaagccactggtggcacatgcccaagctctgtagaactgggccagccacagcagccccacccccgctctgttcgccctcaaagaacttacagtaaggcagctgctctgcaaggcccagtcagagcctacccggcccagcaagtccattctgtggcaagaaaaaccttggggacacacatacccaactgctaagtaagattatctctggggagcgggattacagaaaaaccatagtatctgtatattatgttcatttctgtaatactcaacattttaaaaagtattacctttttttttttttttgatggaatctcattctgtcccccaggctggagtgccatggcgatctgggctcactgcaaactctgcctcccaggttcatgccattctcctgcctcagtctcccgagtagctgggactacagccgcctgccaccacgcccggctaattttttgtatttttagtagagacggggtttcaccgtgttagccaggatggtctcgacctcctgaccttgtgatccgcctgcctcagcctcccaaagtgctgggattacaggtgtgagccaccgtgcccagccaaaagtattacttttaaaaccctaaaaatacaaagggcagaaatgatgcagagacatggatgaacctcacagtcgtggcactgagtggaagaagacttttgcgagagtacagactgcatgactccatttacatcaagttctagaataggcaaaacggactgagggtaaaaaccagagcagaacaggctgtgagcgacaggtgaggactgtccaggatggggcgagggacaagcgcccactgcctggccctgacaggcctatccaggacggggcatgaggaactctttggggtgagggcagctctctagcttgctgggaatctgggttaaggtaaatgaaaatacaattttaggcccttaattgtatgtaaactttacttccaatgaaacctccagacagaggctttcacaggacattctcatctcagaagctcagcacgataccctggaaacaccaccagctaacctttcctgggcactgttgtatgcccgaccatgtgctatgtcactggagccgcagggccacccaggagcctgtgcgttctgtccatgtgatcaggtgggctcctctcaatcttcacacagcacagctgagcctcaaacccagcactcaccctgacctctcacctccccacaaggtaggaaaacctggggctgaaagtgtgcagggacatgtcatctttagccttgggcaaaggcaacctttcccactgatgatttccagatcacccaggggtattggttctgcctcaattttccaactggcacagagatcaagggcgacggtgaagcagattggaagggcaaagacgccacggtgggaacaggttcctatccctcccggctgctctccagctgggtggccctcagtgcatctccagagggcagtcaaaagccccaggccaagaccaccctgcactctggatccctctactcgctcaccaaacacagaccagccaaataaccaacggggatggcagaggccagggcactgtgcacccctcgctgcctcctgacactcgaagcagccccccattgggggacccactagcccatgatcctacgcgagcgaggtcaggccacacctgcccgtgtgtggagcctctggtcagtccacatggctgcaggggcctgtggggaggctggaacagggttacctcaaggcctttcttctaagcacccagcaaagggcaggagagtgtgctctagtcagcatctttcaaaggccaggagagaggaggttttcagatcaaagtgatccctgctgaggcagaaagcagaaaactccagccccaattctgagaggcactgccccaacccagcctggatacccaccttgcctagaaccttggcctccaagaagccaggcattcagaactgctccaggtgctgggcctccacatggctccttctggaggccatgactctgggagacaggaacacatctcacgcccatatccaggcccacaggcgggggtcaaactcagggtcaaactcatctcagccacatgataaccctgccttcagactgaaacttctggctcacgcccagccaggagggaggcctggggagaagggtgaagaccaggaaagggcgccaccccaagcaggccatcccgcctagccctcctaggatccttctcatccaccttcctccctggaagctatcctttactaccaagaaaggggcttcctgcaggaggcctggagctatgctggaggactgaggagaagctccccccagcccactcccaaggagcagcaccttaaccacctcccagcctaaacaaaagtaacagtgaaatgagaaccctccagctaacgccaagacagctgagagtgagcagggccgcccacggcccgcccgagctccactgtcaggtgggagggacaagcatgccaggctgagaagccatgctaggcagggcagggccaccaggcaacttccacaacccagaggtctaagtacatctgaccagggtcagagagagccccagacttgctgccactgctcccaaacttcagtctaaggtcagcatcggccctggttccagaccaacccccaactatagtcacctcatacttcaggtgtggccgggacagatgcagctgcaacgggtggccctgtgtgagctcagcctcttcccaggagcccctaagccatgggagagactgcctggaaggcacaaggcagccaggcaggaggcagccagtatccagaagtgccccaaggcccagcccctggacacaccaaccagccctgcacagtcacaagcccaggactttgttcatcctatccccatggcctggagtcctccctgaggaagccttggtagacaagagatagctccaaggggcgaaggctgcacctcgcccaccgccacagccctgtatgagatggcagcctacatgtgggcaggtctgatctcctcaatcttcccacaggcccagtgagcggggcgttatctctgcagtttcagataagaaattaaaggttcttgggggttaagcaacttgcccagggtcacaagagcatgtaggtagcagagtgaggacctaaagcctgactccagtgttgtagtctgatgacccccccgcccaacgcaggcagggccagggatgccactcacacatggcttccaactgccaagctgcttgggggagctagaggaggcaccgccctccatgcactggtgtgccaggagcagggactccagtctgcacctccaccctcactcccccaccccccagcaccacctgcctatccacagcagggccccacctgggtgtattctcccaaactcactgtgagggcatggggtctgcccagctcctccaccagaagtgacaaggtggagcccccatgcagcctgctttggaggcccaggttgtgcttgctgctcctctgggaacacccccaccctccatgacctccttccctgtcccttcaggaatgggctggtggtgggtggggctcactgctctgggcaagcccagccatgtaatccagcccagacctggatgccggccagcagctcctggctctcctcccagaccatcctcctggaaagcaacaggctccacaaatgccaggagcccagctctctccaacgcagcttctacaaaataaacactcgggttccactcaacacattggtgatgcagcgattgggacctgaggctggcctcctcctcctctgctcctcaggccagccctgtggcctaaagtgagggaggtagcatccaccccagcccagtgactttcccaagcccatcctgaaatgcccatgggacctactgatgacctcgtactgcccacagcagggccaagccctgcatggtccgagccacccgcccatgggtactgtcccttctgaggtgaggaagcccgggctaacaccccagcacaaggaaaaggctggaatgggctgctgagaggagagctggaccgaaagtgcctccaaactgtgcttcccccagaaggtacagcctcagtcccctccctctcctcatcacttccgggtttggagccagcaaggaatgaggccaggaagaccttggagacctgcagctgatttcccctgctagtgctggcaccaaggagggccccaggcctggcacagtctggctgacagttctgagacaggatattggagacaggcaggggaacattgctttaacaagcagaataacggccaggtgcggtctgtaatcccagcactccgggaggctgacatgggtggatcatgaggtcaggagatcaagaccatcctggctaacactgtgaaaccccatctctactaaaaatacaaaaaattagctgggtgtggtggcacgcgcctgtagttccgctactccggaggctgaggcagaattgcttgaccctgggaggcggagcttgcagtgagccgagatcgcgccactgcactccagcctgggtgacagagtgagactctgtctcaaaaaaaagaagcagaataacaatttaaggttgtgatagtgactacgaatgctgtgctcacctccaaactccatcccaacactaccctgccccctaagaggggcctgagcatggggtaaaaggctcgctgacagccacagagcaggagcccacgcaagaccaccagaggatgtgcagctgctgttcctagtaggtgaggaaaaagcaggaatctggcatccacacatgtcaggaggcaaaacaggccctgtgctggtttctgcagtcctctccagcccacttccctgctcttcttgctcactggccatgacccaagaaacagcagcagcaccaccagggatcttgttagacacgcagaggctcagactccatccagccctaaccaccagaaccctgggggctcaaacacacagtcaagtctgagaagggctaggttagaagctttttttccttcttttgtttttacctggacaccactgattggaaagctctctacggcctgaaagccaagcgctccacaagtagtaaacgctcaagggatgggcatcaagtggaaggagaaagcccccaaaacgaagatacatgtcccatgtacacaagctcacaggctggtgaatacaaacggtagacctagaatgtgccacaccaaggctgagcgtgttaccacaggtaccagaatggtgaccacgctggagggttccacaaaccctgatcagagaagtaggcgtgagtggcaggcagagaacacagctctgtgtggcagggagggaggacaagcagtggcagcacagcagacaacaggtggaaattctacatgaaaggcactaaatgggcgaggaaagcctgggccgcccaggtggaagggactatcgtgatcatctctctcaccctagggacaccttaaaaggaggtaactgagccccaaagggaggcacccagcacagctgagtcacagagctgcagccatccaacccacagctccaggagggactctccaacttcacaatttcaaaatcaaccctagcagctaacaatttcttaatgccaagtaaagactagaattagaaacaaacagaaaccctatcatcttctaccatcattacttcacaaaagaaaacatttcaatgatcaaagagcaggaagaactactggcagtcctgcacctatgcagttctccaggcctggcaaaggctctgaggcaaccagcatgaaggagccactgcaccgtctgtacgcaacaccgcctgacccccgggctgggacaagactgagatgacatgctgaaagggaatcagaaaaaacaaaaacacaaaaattcaacaacagatactaaagacgggattttgactagccaaacaaagactaaaagagtatctcccagggatgaaaggaaaatggggatgtttttaaacaagaccaggactgttccagaaacaataagaacgtcaaagcccatcaggaaaaaggtaacaccaaatgttggccaggcagtaaggcaaccagaagtctcacatactttataattttttatttttttgagagagagtcttgctctgtcacccaagctggagtgcagtggcgagatggctcactgcaaccttcgcctcccaggttcaagcaattctcctgcctcagcctcccgagtagctgggattacagaagtgcagtgcgccaccacccgcagataatttttgtatttttcgtagagatggggtttcaccatgttggccaggctggtctccaactcctggcctcaagtgatctgcccatctcagcctcccaaagtactgagattacaggcataagccaccgcacctggccagaaaactcacatggtttagaaaacccttggatggcacaatctaaaactgtgggcccaaggccgtgggtggtggctcacgcctgtgatctcagcactttgtgaggccaaggtgggtggatcgcctgaggtcaggagtttgagaccagcctggcaaacatggtgaaaccccgtctctactaaaaatacaaaaattagttgggcgtggtggcaggctcctgtaatcccagctatttgggaggctgacgcaggagaatcacttgaacccaggaggcagagcttgcagtgagctgagactgcgccactgcactccagcctgggcgacaagagccaacttcgtctctaaataaataaagcaaacaagctagctagctagctagctgtgggcccaaaaactcacccaaggtatacgccaacaagaatgcacacgtatgcacaccaaacaggcaggcacactcatgaaggcccaacaatggaaaacaactatgcccaccctgagaagggacagctgcaggtataaaagactatgagccagcagtgaacaggacagaacgtttaggttgaactgtatgaatttaccttttaggggtaaaaaaacagctggctgctgataatttcacatggtttgacttacaaacaacgcagatgaatctctcaaatatacttttgagcaaagatgccagagccaaaaagactattacagttccatttgcatacattcaaaagcaggcagcactaatcttatgggtgggggttgagagtgactacaagcttcaggatacgtgaggggcttccagggttgtgtttcgcactctggatgctagttacaagggcataatcatttgtgaagaactcttggagctgtgcacacttcttacgtaggctgtccttgaattcaatacgtgcacagaaaccttcagaagggaagcagagatcaacttcatcctgatcagcaagtagactcagtccaggcagcaacctctcctggacccccaaccaataacaacaacacaggaagcaaaatattggcaggacagctggcaacgcggcaatgtccaggatggagtgcccatcctagaggagggagctcacacaagccagccaggagcccacaggaaacagagagactactgtaaatccttattaagagcagactcatgtctgctatctaaaagataaaaacctgataatgtttttaagttgtcctaaggtccaattgactttttttttttttttttttgagacagagttttcctcttgttgcccaggctagagtgccatggtgcaatctcggctcaccgcaacctccgcctcccgggttcaagcgactgtcctgcctcagcctcccgagtagctgggattccaagtgtgcaccaccatacctggctaattttgtatttttagtagagacggggtttctccatgttggtcaggctggcctggaactcccgacctcaggtgatccgcccgcctcggcctcccaaaagtgctgggattataggcgtgagccaccacacccagccccagttgacacttctaaaggagaaggggttctgcaaatcctgaaaggcaagcccaggagaaacaggaaatctgggagcacggcaagcaaggttcaaacaggacaccaaataattcccagcaaccgcctccagcaggtcctggtggcagccaggtagggcaggagccagctgggcatatcaaagggaggaagccaagaagaaaatgggcgagactctcagggatttggggtcaaaggaagccgctgggagaaggaaacagcccacttgctccttcataggtaatcaacacacaaaccccccagtgcctcaaatggctcaggagctacagccaaagatcaaggatcaagttattttactccaagaaagaaaaaaaaaagaaaaagttatacattcggcatccattggaagttttgtgattgtttggagacagggtcttgctctgtggcccaggctggagtgcagtggcgcgatcatagctctaatttatgggctcaagggatcctcccgtctcagccttttgagtagctggaactaaaggtgcatgccacgatgcccaaccaatttttaaaattttttgtagagatgaggtctcactatgttttccagactggcctcaaactcctgggctcaagtgatcctcctgcctcagccttccaaaatgttgggattacaggtgtgagccactgtgccaggccttaaaaagcaatttttacagataaaattgggcaactgctatggaaaatattacaatctatggtcctgtgcctgaaaagcctccaagtgtgatactttatagagaagaggtctctcctgtccagtaggtaacttgaaagtgtctaagagacaagtgcccaagaactcaaagaatgagagagggatccattcaaactcagggagaaaaatgctcacaaagtttcactgtacttctaaactgagtctcagtggtgcattaaggaactggatttagagacagaaaacaaaataaactggcacttctctgcctcaagaagcatagcttgggggtgaaaagtcagctacttagaaagcagcaaaaacaaaacccagaaacccacccaaatgctcactgccagcaggacaggtgattatgtgtggatggcgccaccttggacactgaaatggagaatgggaacgcaggaactgctgctcctggtgtcccaagagtgcaggacacccggctcccagcgaactgagccaaaatcattcgcagtttcaggatccagacaaaggtgggaaaccgacaaaagccagcgaatggctgacccgcaattcagaagactgttggcttctagagggaagtgggaataagccagggagaagtgcatggggtgtcccaggaacttgggaggctatttcttatgtggccatgagggaacaacggtgtcacgcttagtgggacacccacgattcaaccaatagtgggtttaccactacttatctattctttaagatttgtgcacacacatatatacgtgtaatttacctttgtttttttttttttttgagtattcctctgtcgcccaggctggagtgcagtggcacaatctcggctcactgcgacctctgctgcccgggttcaagcgattgtcctgcctcagcctcccgagtagctggggattacaggcacccatcaccacacccagctgatttttgtggtagagacagggtttcaccatcttggccaggctggtctcaaactcctgacctcaagtgatccgcctgcctcggcctcccaaagtgctgggattacaggggtgagccaccacgcccggcctatttacacctttgtaaataacttcttagagttcaatggctaagtatactaaggaagctgagcctgctctgtgcagaagtctcaaaagaaaggaaagtcgggtgtggtggttcatgcctttaatctgagcactttgggagattgaggcaggaggatcgcttgagcccaggagttcaagaccagcctgggcaacaaggcaagaccctgtctcatttataaaacaaacaaacaaacaaacaaacaaaaaacagagagagagagagaaaagaaagagaaaaaagaaagaggaaagagacctccctggaaatcccaatccagggagaagccaagaggctaaagctgaggtgcactcacagagcacctccctttcaccacccgagagatcacctggtccacagccgtcaaactcagcaaggccacacacttgggcagctatgacaacaatgcacaaatgagggctttggagggctcagttcccacaagagataacccagaaaatatcaccctgtcctaatcatacaaagcaaaagaacctggggcctccacacctggggtagcaggtatgcttcactcaacagaagttgtccaggagggagaaatcccaggcaacctcccaaggtctacaggagaaagaagggcagaatcagagccactctaagtgaaaatatcagcgtttagaacacaatcacccccctgcaacccctccagccaaccctcgcctagtccctgtaccctccaattcagagtccaataaccctgagttatctttctcaacacccatctcatcaagccactcccctgcttaaagctttcaatgggccgggcatggtggctcacacctttaatcccagcactttgggaggcccaggcgggcagatcatctgatgtctggagtttgagaccagcctgaccaacatggagaaaccccatctctattaaaaatacaaaattagctgggcatggtggcgcatgcctgtaatcccagctactcaggaggctgaggcaggagaatcacttgaacccgggaggaggaagttgcagtgagccaagatcgcgccattgcactccagcctgggcaacaagagtgaaactctatctcaaaatacaaaaaaaaaaaattaaaaaaataaataaagctttcaataaattcctgatgcctagcataaagtccatgctcaggcctggcatgcaaagcacttcccacaggggcatcaagcccacctcatcccttccacagacacacctgagagctcctgcaggccgtgccctactctgggaggagcctgccccctcacgactccctcctctgtgaagccagaactgcctctgttgtccccccgcttccaacgtcagcaccagctgccaagctgcttccctcctgcctacccccaccaccccatagaccagtacccaaagttagaccctgtgtcccaagcagccacagcagcaggcatgcagcaggcactcataaacattcattaggtgagcaaatgctggtcagacccaatgctgagaagagacagagtgaaacaacatgtgaaagataaggaggcacgtggggaagatggaaatgtccagtaccctccttgccactggttctaaaattgtgttgtttacattctgaaatagtcagggctcctaacgagcatctgcttatgtggcttctctattactgttttgtggggttttttctgagacagggtcctgctctgtcacccaagctgaagtgcggtggtacaatcatagctcactgcaacctcgaactcctggcttcaagccatcctgcagcctcagcctcccaaagtgctgggattacaggtgtgagccactgcatctgggctgttgctgtatttgatgttaccatgtactacaacagtgccctcttattcagtttttttttttttttttcctgagacggagtctcgctctgtggcccaggctggagtgcagtggcgtgatctcggctcactgcaagctccgcctcccgggttcacgccattctcctgcctcggcctcccgagtatctgggactacaagcgcccgccaccgcgcctggctaatttctttttgtatttttagtagagacggggtttcaccgtgttagccaggatggtctcgatctcctgacctcgtgatctgccgcctcagcctcccaaagtgctgagattacaggcgtgagccaccgtgcccggccaaaaaaattttttttaaaggctgagcacagtggctcacgcctgtagtcccagcactttgggaggctgaggtaggtggatcacttgaggtctggagttcgagaccagcctggccaacatggtgaaaccccatctctactaaaaatacaaaaaattagccaagcgtggtggcaggtgcctgtaatcccaactacttgggaggctgaagcaggagaatggctttaccccaggggagggtgtggggtggaggttgcagtgagccaagattgtgccattgcattccagcctgggcaacaagagcgaaactctgtcttaaaaaaaaaaataggctggacgcagtggctcatgcctgtaatcctagcactttgggaggccgacgcgggtggatcacctgaggtcaggagtttgagaccagcctgcccaacagggtgaaatacaaaaattagccaaatgtgttggtgcatgcctgtaatcccagctactggggaggctgaggcaggagaatcacttgaacctgggggaagcagaggttgcagtgagccaagatcacgccattgcactccagcctggacaagagcaaaactccctctcaaaaaaaaaaaacaacaacatttaaaaaaatacaaaaattagctgggcgtggtgacaggtgcctgtaatcccagctactcaggaggctgaggcagcagaatcccttgaacccaggagacggaggttgcagtaaggagagattgtgccactgcactccagcctgggtgataagagtgagactctatccgaaaaacaaaacaaaaaaagggctgggcacggtagttcacacttgcaatcccagcactctgggaggccgaggcgggcggatcacgaggtcaagagatccacaccatcctggccaacaggtgaaaccccatctctactaaaaaatatatatatacatacaaaaattagctaggtgtggtggcgcgcacctgtagtcccagctagctagaaggccgaggcaggcaaatcacttgaacccgggaggtgggggttgcagtgagcagagatcgcgccactgcactctagcctggcgacagagcgagactgtctcaaaaaaaaaaaaaagaaaagaaaagaaaaaaagaaggatagcattgctttacacttttataaatctctttaatgtctagcctaatagaagaagctggattctcatatctcctgcattcagtctgttaggatatgcggttttgattaaagtctttaaagaaatttggccttacacagaaagaaggaaggagtattttaataactttttcagaaaactgtctattcttcattgatattacactaaagctcgacaaatgagtttcttaaaagttgctatgggccaggcgcggtggctcacgcctgcaatcccagcacttcgggaggctgaggcaggtggatcacttgaggtcaggagttcaagaccagtctcgctaacgtggtgaaatcccgtctctactaaaaatacaaaaattagccaggtgtggtggcaagcgcctgtaatcccagctactcaggaggctgaagcaggagaattgcgcaactgcactccagactagcaacagagcaagactccgcttcaaggaaaaacataaataaaagttgctatgtaggccaggtacggtggctcacatctgtaatcccagcactttgggaggctgaggtgggcgatcacaaggtcaggagtttgagaccagcctgaccaacatggagatacccagtctctactaaaaatacaaaaattagccgggtgtggtggcacgtgcctataatctcagctacttgggaggctgaggcaatagaattgcttgaacccgggaagcagaggttgcagtgacccaagatcgtgccactgtactccagcctgggcaacagagactccatctcaaaaaaaaaaaaaaagttgctatgtaggctgggcacagtggctcaacacctgtaatcccaacactttaggaggtcgtggtaggaggactgcctgagcctaggagttcaagaccaggaagatcccatctctggaaaaaaaaaaaaaaaacagctgggtgtggtggcacatgactgtggtcctaactactcgggaggcttatgaaggaggatcatttgagcccagaaggtgaggctgcactgagccgtgattacatcatcactgcactccagcctaggcaactgagggagaccacatcgtcaaaaaaaattaaaaataaaaaaaaaattgtaaagcctcatgccgggcatggtggctaatacctgtaatcccagcacttcgggaggccagggcgggtggatcacctgaggtcaggagttcaagaccagcctggccaacatggcgaaacccagactttattaaaactagaaaaaattacaccaggcgcagtggctaatgcctgtaatcccagcacttcgggaggctgaggcgggcggatcacgaggtcagaagttcgagaccagcctgaccaacatggtgaaaccccatctctactaaaaatgcaaaaattagctgggcatggaggcgcatgcctgtaatcccagctactcgggaggctgaggcaggagaatcgcttgaacccaggaggcggaggttgcagtgagcgagatcgcaccactgcactccagcctgggcgacagggaaagactccgtctcaaaaaaaaaaaaaaagaaaaaattaaccaggcgtggtggcaggcgcctgtaatcccagctactcgggaggctggggtaggagaatcgcttgaacccaggaggcggaggttgcagtcagcgagatcgcaccactgcactccagcctgggcgacagggcaagactccgtctcaaaaaaaaaaaaaaaaaagaaaaaaattaaccaggcgtggtggcgggtgcctgtaatcccagctactcgggaggctgaggcacgagaatgacttgaacccaggaggtggaggttgcagtgaactgagattgcgccactgcactccagcctaggcaacagcgagactccatctcaaaaaaaaaagcctcatgcatccttcctatttcatcacacagaaaagtaaaaatatgtgtaattaaaggtctagatttaatactcagtcatctgtactgcctcccctggacatgtgtagaactggtgggtctcagcccccagtgctggctaacagtggggaacacaactctggcagtgcaagtgtccacccagggcagaggccagtgatttttttttttttttttttttttagatggagtctcgctctgtcacccaggctggagtgcagtggcaaaatcttggctcactgcaacctccgcctcccaggttcaagccattctcctgcctcagcctcctgagtagctgggactacaggcgtgcgccaccacacccagctaatttttgtatttttaggagaggcggggtttcaccatgttggccaggctgatctggaactcccaacctcaggtgatccacccgccttggcctcctaaagtgctgggattacaggcgtgggccaccgcatctgaccttgtaacttctaaatatactgaaaaaggtatcggggaccctcagggtctgcaaacaactttgagaatagctgacaagcactgcctcaaatatttctaacaactcgtttacaggcaaggagaatgaggcctggagagcttaagagactggcccacggaggaagcaggagtcatctttccacaaaactacacttccccaaaagctgaactcttggacaaggagcccactgccaaacctaagagtaacaaatttcagcaaataaaaggaagtgccatttccaatggcatcctcgaatactctaagaggcggggctggcagaatccatcaacaggcctccagaggcctgctactaagagccagcaacgctgctgaaagcggcactgcctctgcaggctgtgtgaccaggacccggcgggggccctgcacctggaagcagagggggtcggtgggggaggggtgctaccaggaagcaagatgtgcatgctgcctgctgggggcatgaagtcaaagtcccctcctgcccaaagtggctaggccagccctaggctgccttatcagcatcaacacatgcctggaatgtgggactttggcaacaaccctctcccttcggccagcacggggctgacgcctggtccctgggctctggttcacagtcagaggacaaccaccttgaagcaccagaacccgcacccccagcccatctaccagaagacaatctaccaagagtcaccgagaggagctatcctgcctgtgtccccacaccaccaagggccgtgtctgagcacctcgtttgtccacactcagagaatctcaagagctcagctctggtccctgcaatgtccagaccatcccccacatggctctcctggaggtgttcggcaaaggcacaggctgccgtggggcagaagattcccacataccagacagtaaggagctgcgtgtgactggaaggatgaggacgacccagagaatgctctctggcccctggtccttggggaggaatgggggacctgcaggggaccaccttcccactctgggagccagattccctggctttgtccagagcagccaacccactaccccactcaaaatgaacacctcagctgccctccagcccaagcactgcgcagagtaaggagtcctcactcacaaatgtgtccgaggctttcacacacttcacctggagcttcgccactcacttcttagatgtacgactctgacttctctgagccacttgtacaacgaggactgacaagatgatgaggaccacaccggtgtgttctgacaactgaaccgggcatagaatgcccactgccaggctgagcccaggaacgagcccaggatgagtgcttaccctcttcaccactaccttcctagccttctgtcagaactccgtggggaccatcctcttcccatcttctaagccaagtaccctggtacaagccagacagaaactataatagcagctgcttccataaaggggaagggccatggggtcccggacagggctggggtgaaggggcacaagacctagggcaggaatccacccccagatcactcactcaggacaggaccacctggacccagctaccaagatgtgcaccacccccttccttctgagccccttttcccatctcctctactgcccctggccaggttgctgtcccacctctaagaggcaagatttcctacccaggatgctgaccaaaaccacacccaggggcctacccgtcccctcacatgataggctgctcctagctggcaggagccgtcttatagcctctctccctcaaatacaaacaaaaccccagaacaacctattgttctgttccagcaaagggggccaggcccagccaggccctacctgaagctctctgtctcccgtcccccttcagtcccctcccactcgtccttctctgcccctattagtggcctcatataccttgtccagataacacagcccaagaaaccaacctcagggacaaatctcttctcttccagggagaagaagacagaggtcccaggagtcccaggggcccccattactggccacctccgctcaacccaaactgcactatgtgaggtcccgccagactacatacaggccaacgagagcccaagaatgcagccaggaaaccaggccaggcagactccaaaagcccgtgctacggggtcagtaggacccgcctacagctgagggctataggcagctctccagaggacctcccaggagaagccaacagtgcacatgggctaggttcctcctgctgttcaccctctgtgcccagtaactacccaggaacaggcatgactgactctgccaactcattcactgggtaaccgctgaccccaccaggccctcggagtaaagcagttagtgagaaccgcaggtaaaagcgcgggctactcatccctccgcctgtggattctattatcaacaaagatgcatcacctgctagaagagcggttctcaaacttggctgcacatcaggttcacttcaaaagcttcaggaaaagctagtgccttgggcccaccccagagacaggtatagctcaaggtgagaaccagagcaccagcaggcaggcctctgccaggcagcatgggcaacgtgtgctgggtgaatgtgcggcctgcactcatcacccagaagagccccactgtgtccacacaaggacaggccaccgaagtcccagtccccactctcccttctcacttactttgtgaatgagagctcaccaacagtttaccgtcttccgagtgctgcggcctcaccgcccgacccgcagcaggggtgagggcttgcaaaggccatgcaacagatcctccccctcaaaggggctcaggcctcagtgtggtaatgggagcggccccttcccacacttgtcagagaacccacccacccggtggaatgaagccgaagcccaagccgcagggcaacagcccgggacggcaggggacaagtctgtacagcagccacacccctgccagagccaggagctcttccatttccacagcaggccaactctcacctggaagcacccacctaaccaaacccaatccctgccttcttttagtcacactgggaactgccacaggaaggctggggactccacatactccctcctcaccacaccccatgtgtgatcacccttaaacagaaaacatgcacctaagatcctacgatgcgctgcccacctcacaaaaaaccggtgcctctaggtaagagcacctagctgacccatccctgttccctctcaccattagaaggacccccaagtccccctgttctaacaccgaggctgcactcccactctccacccactaacattaccataaaaaataaattgaatagttagaaggaggggctccccaaagcctggccaccttcccgagggtcccaagcagtttcttggagtccctctccccactcagtcccgccacacccctctcaggcagtctggcccttccctcctgaactttggcgggctggaaccagctcccagcctctcctcccttatcaagctcactgggggcccacacagagctcccatccccaccagcttttctcgctttgccactcccagctaaaactgggctcaaggcaagcaagcctgcagtccctcagtccctcggggcccagcccctcctcagagccctcccccagcccaggtccctaacccttagggcaaggcccctcccagcaggaagcgaaccctggcggtgccaggcagagtcaaactggaagggctggttcagaagcccctaaatgggagccaggacctctcttagggagggggctttcagccccatcctccctagtgcgatctcagatctctccagacaccacactatatgggcctccacaggcggtggagtcaaaggcatttaccctccagcccccagcaagctacttaacttccaaaagcagctccttccctcctccagaggagaacgggccgcgtgctgaactgcaagcgcctctatcaccccgcccaggcaagtctgtgagcaccagaaagcaggggccaacatgacttggtctaaaccaagggggccaggcactgactttgcgctcagaaaatgtggcggaatgaataaaaagcttgaaaaagagccgcatacatgcctggctggcagtggggtctcccaagcgggcttcacagctcacacagtacccgtgggtccgcgtcctcagtgctctccagctgtctccactgccaccctctaccctaccactgccttttaaaacccagtagcagtcacttcctggttaaaacccctcccctccaggccaaccccaacccacatggcatccagggttctcagccagcccacggccggctcctcccacgccaccgctatgccctctgcgctccgctagatgccagcccttatcaccccatcttataatcatttgttgagtgtctgccttccctaggctgagctccagaaaacagcgatacatgaatgtaaactccagttctgttcccattgtagaaacgaggcaggagagtcaatcactgctcaaggtcatgacgggagtaaatggcagagccagcaatgcactacagactttgcgaccgaccaagtccagttcccctctcactgccccacaggggtccgtcctaggccaggctcggaggagacaagaagggaggaacccaatgtgttctttcttcccgcggtgaaagctgcctcccaggccagcaagagcagcccagaagaagtgccccactctcccagggatcaggtactgggggcagcgggcaggacaaggtatggggtggggctgactgctccaggccaacagaccaagcaataaggttggaaccacaagtcccctgggtaaactgaactttattccttcctcacggctctcactctccagaactgccccgccagctcttctccaggggctggctgctgattaaatggcacttccccacccctcagatctgaccccgcaaacaataaggacttgaggggaggcggcaggctatcagctcaataatgcaaaaccctgttgctcctcgtccacaacagctgacttcaagtggatgggaggctgcgcttattaacaaaatgagaaatctgatctacggaaagaaaacactacgtgaggattaatccgcgactgcagcttgtggagaaggctgggctgctggccaagaccaaggatcgaggatgggatcgtgcctacctgtccccagagcaggtatcatgcagcacaacaggactcatcacccctgccccacctgcgccttctcttctccttccagcaacttcgacaatcatttcggttttgctttaattaaaggcctgactccctcgggctgcttcttcctctacacagaggcagcaaccagagggagatttttcttttcaggaatcggtcgtaaaaactcagtgactaatctacaagttccaacaactggcagaaaaacaccgcagggagaggttgctgggcacacagcagcactcagagccaactgaccagagaagctgggccacaggcactctactacaacctccctcccccagcccgacactggcctgccgacccacctgagagctctgacctcccaaggcaggcagctggggagcctcttcccagccttccaagtctactgctcgtcctgtgggacccagagatcttcacagtctcaatggcacaagacggaacgttcacttccaggcaacaatcctgggccacaggactcagttcagcccccaagtatcagactcccggccctgttcttggtgttcagagcccactaaaccagcagtcttgccacacagctttgtctccagaggccagctcatctgctttttttcacactactccagcaaccctgctccaccaagcacgcacactctccttgacacagggctccagaccaaccacatggcctgtgctcctgaaaatgcctgcctgaaggcccagggagtccagacactggcagatgagaatggacgaaaagaagccaagccagaagccaggaagcaataaatgctagacccagaaaggccttaggtttgagtgacccagctccatccctccatcctggatccttggaggacagccccaagttcagcctaggagctcccaaggcccctccactacctgccagctctccgacagcacaagagacacagcaatcccacatcagtcaacaacccaccgccacaggattcctaggggcaaggctctgcccctccccccagcacatatgtcagaggggtggcttccctgggttacacccctcctgctgttgggggagtggggggtcggggaacacagctttccagatgtgcttggcaactcctactagaaaagactaggggtgcgggggacaggagaagacatggataaataactttaacaccgctccaacccatccggctcagcactgggctcccttacacaggcagtcccaggcagttctgggtggggccgttgggagcattatctggcctcattccctcctctcagcaagtcactgccccccagggagaggcattcccccccccccccaaccacgcacacacccaggcctgtgtgaatatgaaccatcttggaagataaacagagagtgacaagctggggcccctcagccccctccctcagccagccggtcccttccccctgaaagccgaccccctcccccaagcccatctctcttcctgccaagcggctgcctacaggagaggtctgggggcagggcagcgagcccaccagccgcagagcccggccctctgggagcggcccctccaggcccgcccctgcccctgccgtggccagtcttcccgcggggaggaggcaagaggagaggagaccgcagacggtgcaggaccgcagtcctggaaatcgcaaaatcctctagcgagggggcggccgcgggcgcagggccgtttgcataatgggagccctcccgcctgtcaggcagcgcagctcgcccgacgctgttcggattagattgctaatgaaaaggcacaaagagccggcgcccgctcgcccgccgacccccgctccgcagacccgcgccgcctgggcctggcgcggcccggtgggctttgtgccccgggtgccccaccgcccgcgcccctccgggcatctggcccacaaagcccgggcctgccaggggtcccgcgtgcgccccagcccaggcccgccagacgctagcgcgtcccccacgcgcgcagtcccacgtcgcccgggcgcgcgcgcgtccacgcccctctccccggggacgcgcccagcccgcggccccggcccccgcccgctccccgcgacccccgccccccaaggccgcccctcacctcgtgtgcgtcggcggcggcgctccgcccgccggccggccggccctaccagcggcccttgtcctcagcgcccggctcgcgccgcacgcgcccgccccgtccgcctgccgccagcccggctcggctccccgcctagcgcgccccgagcgccgctcacagccgcccgcccagcgccatcttggaagcttgtgacgtcggcgccgcccgctcacccctgacccacatctgaatgggcgagcggcggggcggggacagggggcagctgggggcgtggcctgtgaacaggggcggggcctcgggggcggggccgggccggacagcggtcccagcactaggcgggcgggctgccggggtccggcgccgtggggaaggggtgcgcgggaggagacggggacccagaccccggacatctaaccggactccgacctcaagcgccagggcaggaccgcgacctcgcccctgaaatacccgaaccgcataccggcccccgggacagggaccctggccccccccgacaggctgacgcccaccccctcaaactctggtggacttacccccttttagccctaccctgacccctaggagccccgaattagggacctctatcggcctacgcgccccctccccgacccctttgcgacccctgctcgacgctccctgcggttgcccgaggctcaaaggcgcagccagcagtgactgcaagctcgggggtctgggctcctggggaagcccgggctggttgggtgcaaaagagaaggggcgcccctcccgtgaccccagcgcccctcgggcccccgcgggcgcacccccgcgaaccctacctgctccgagggcgcggaggacccagcacgctgcgctcagccagccccttccggtggccgcagcccctcgcaggccccaggggtcaagcgcctgcccgagccggcccaccaggacccgggctcccggccgccatgcagatagccttcccaggggctgggctggcctgagccgccactgcttctctagggagctagttaatggacctctctctactttgaacaccaaacaaaggaacacaccgctatcgaggtcgcccaagtccaagaggagcccaggtctgccttacagggaagttgtgccccagctccagtcaagatcaaaaaccagtttcaataacccttcgccaagctgatgatgcaacctttctttcctaatggatgtataggtttaatgtcatcctaacaacatttcttagacttcacaaaattctaagttcacctggaaaaataaatagccgaaaacagctatggttttccccccttgggaacaaaagcaggcatgagggtagacttgccctaacagatatcaaaacaaattgtaaagctaccgcaggcatttcagtgtggtacagaacaggaaatagaatagaaagcctagaaacatcctagaaatggtaagaacacaatagatgaaaaaggaaatatcaaacatctgtggaaaaaaaagagctatcaaacatccctgaagaagaacaagaatattccacaaatagagcctagcagaggactcactatttgaaggaacgactgaaaaaaaaagtcaaccattctactaacccaagacatataaattaaaactataggccgggcgcggtggctcacgcctgtaatcccagcactttgggaggccaaggcgggcggatcacgaggtcaggagatcgagaccatcctggctaacacggtgacaccccgtctgtactaaaaatacaaaaaattagccaggcgaggtggcgggcgcttgtagtcccagctactcgggaggctgaggcaggagaatggcgtgaaccccggggggcggagcctgcagtgagccgagatcgtgccactgcactccaacctgcgcgacagcgagactccgtctcaaaaaaataaataaataaataaaataaaactataagaagctgggttttctcctaaacaaattaaaaatcagtttcaagtgataaccttcaaacacaaggtctgataggtaatcactctcatatacttttggaagcacataaatcacctcaaaattcctggacatgagtttggcggtatgagccaaaagttgtttttttggggttcttttgtctttttttgttttttggagactcggagtctcactctgttgcccaggctggagtgtagcctcaaactcctgggatcaagtgatcctcctgccttccaaagtgctgggattacaggcataagccaacgcacctggccccaaaaatattttaaaataattataccctctcagaccagtattccaggattctgttctggggaaattagccacgtttgcagaccacgtacttattatctgtctctctacccataagtaagtttgtacctgtaagtttggaacccatgcctaggagcacacctgagacaacaggcattccacggtcccttgtttcatctgcatttgaaaactaatgtggctggctcatgcctgtaatcccaacactttgggaggccaaggccggcagatcgcctgaggtcaggactttgagaccaccctggccaacatggtgaaaccccgtctctactaaaaatacaaaaattagccggatatcgcggtgcatgcctgtagtcccaattactcgggaggctgagacaggagaattgcttgaatctgggaggctgaggttgcagtgagctgagatcatgccatgacactccagcctgggcaacagagggagactcggtctcaaaaaacaacaaaaaagataactaatatatgataatattttttaagtgtcatgtataatagtgaaagaaagcatatacaggcggtggctcacgcctgtaatcccagcactttgggaggctgaggcgggaggatcacctgaggtcaggagtttgagaccagcctggccaacatggtaaaaccccgtttctactgaaaatacaaaattagctgggcatggtggcgtatgcctgtaatcccagctacttgggaggctgaggcaggagaattgcttgaactccagaggcggaggttgcagtgagctgagatcctgccattgcactccagcctgggcaacagagcaagactccgtatcaaaaaaaaaaaagaaaaaagcatatacaaatttctcacaatggggttaaatagtccacataatggaatgtagattaggccaggagtagtggctcatgcctgtaatcccaacactttgggaggccgaggcgggcagatcacctgaggtcgggagttcgagaccagcctgaccattatggtgaaaccccgtccctactaaaaatacgaaaagttagctgggcgtgattgcgcatgcctgtaatcccagctactcgggaggctgaggtaggagacttgcttgaacccgggaggcggagattgcggtgagctgagatcgcaccattgcactccagcctgggcaacaaaagtgaaactccgtctcaaaaaaaaaattagccaagcatggtgtcacatgcctgtagtcccagccactcagcaggctgaggcgcagcacgagagttgcttgaacctgggaggcagaggttgcagtgagccgaggtggtgccactgcactccagcctgggcgacagagtgggactccattttaaaaaaataaataggccaggcgcggtggctcacgcctgtaatcccagcactttgggaggcccaggcaggtggatcacgaggtgaggagttcaacaccagcctggccaagatggtgaaaccccgtctctactaaaaatacaaaaattagccaggcatggtgacgggcacctgtaatcccagctattcgggaggctgaggcagagaatcgcttgaactcaggaggcggaggttgcagtgagcccagatcacaccactgcactccagtctgggcgacagagtgagactcggtctcagaaaataaataaattaataaataaataaattaaattagtaggatgggcacggtggctcactcctgtaatcccagcactttgggaggccgaggcgggtagatcacccaaggtcagaagtttgagaccagcctggccaacatggtaaaagcccgtctctactaaaaatacaagattagccaggcatggtgacgtatgcctgtaatcccagctacttgggaggctgaggcaggagaattgcttgagctccagaggcggaggttgcagtgagctgagatcctgccattgcactccagcctgggtgacaagagtgaaactccgtctccaataataataataataataataataaagtaaatttttaattaaaaaataaaatttttatttatttatttattgagacagagtctcactctgtcatccaggctggagtgcagtggcatcatctcagcttgctgcaacctctgcctcccaggttcaagcaattctctgcctcagcctcctgagtagctgggattacaggcgcccaccaccacacccagctaatttttgtatttctagtacagacggggtttcaccatcttggcaaggctggtctggacctcttgacctcatgatctacccgcgttggcctcccaaagtgctgggattacaggcgtgagccactgcgcccagccaaaaataatttaaaaaaaaaaaaaaaagaagaggccaggtgcagtggctcacgcctgtaatcccagcactttggaagactgaggcaggaggatcacttgaggtcaggagttcgataccagcctggccaacatggtgaaaccccatctctactaaaaatacacacaaaaatattagccaggcatggtggcacacccctgtagtcccagctactcgggggactgaggcaggaggatcacttgaacccaggaggtggacgtttcagtgaaccaaaatcacaccactgcacactccagcctggtcaacagagctagaccctgtcttaaaaaaaattgtattttttgtacaaaaaaattagccgggcctggtggcagatgcctgtagtcccagctactcaggaggctgaggcaggagaatggcgtgaaaacctgggaggcggagcttgcagtgagccaagattacgccactgcactccagcctgggcgacagagcgagattccgcctcaaaaaaaaatttttttttaattgcattttttaaatgcatgcaaaaatattgatatatggaaaagcaactgaagaaaataaatcaaaaatatttacggaggttctctctggaagttgggaattttttttctacacatgtatactttagcgtgtgtgttatttttattttatgaaagtaacatttctaatcggaacaattctagagatgctgaagcacattttatttttattttattatttatttttgagacagagtctagctctgttgcccaggctggagcacagtggcgtgattatggcccactgcagcctccacttcctaggctcaagtgattctcccagctgggactacaggcatgcaccaccacacccggctaattttttattttctgtagagacagggtctcactatgcttcccaggctgaactcaaactcccagactcaagcaattctcccacctcagcctcccaaagtgctgggattacaagcatgagacaccatgcccggtaattttttttttttttttgtgcagatggagtctcgcgctgtcacccaggctggagtgcagaggcgcgatctccgttcattgcaacctccgactcccgggttcaagcgattctcctgcctcggcctcccaagtagctgggattacaagtgagcaccgccacaccaagctaatttttgtagttttagtagagatggggtttcaccatgttgccagggttgtctcgatctattgacctcgtgatctgcccacctcggcctcccaaagtgctgggattaccggcgtgggccaccgtgcccagcccatgcccagcaattttttaaagttaaattctccctcctcctccaccctaatcagtcctttctgaagtaacattaacagtttaactctcttctctgacatcaatatgtatctactcaccttacaaaaaagatcctactattttgaaatcatagacatttttctagttcatttccataattcattcttttttttttttttcatgtcagacgggtaatgtgcctatgtcgtaacaagatttgaaggtggcggccgggcgcggtggctcacgcctgtaatcgcagcactttgggaggccaaggcgggcggatcacgagttcaggagattgagaccatcctggctaacacagcgaaaccccatctctactgaaaatacaaaaaaattagccgggcgtggtggcgggtgcctgtagtcccagctactcaggaggctgaggcaggagaatggcatgaacccgggaggcggagcttgcagtgagccaagatcgcgccactgcactccagcctgggtgacggagcaagactccctcttaaaaaaaaaaaaaaaaatatttgaaggtggcacatcttacatgggaacgtgtgtgaacacataatcatcatgcttatgaactacaaaaggatcataattcattctttaagagctgacaaatgttccagagtatggagcttctgtaatttattcacacttcgttaaccatggttgttcagtttatttacagtgtggtgctttttgttttcttttttctttgttctttttttttttttttttttttgagatggagtcttgctcctgtcacccaggctagagcgcaatggcacaatctttgctcactgcaacctccacctcccgggttcaagcaattctcctgcctcggcctcctaagtagctgggattacaggtatctgccaccatgcctggctaatttttgtatttttcgtagagacggggtttcaccatgttggccaggctggtcttgaactcctgacctcaagtgatccacccgcctcagcctccctaaatgctgggattacaggtgtgagccaccgcacccagcctacactgtggtgctattaaaaaatatttttaggctgggcacagtggctcacacctctaatcccagcactttgggaggccgaggcaggtggatcacttgaggccaggagtttgagaccagcctggtgatcatgaagaaaccctgtctctactaaaatattagccaggcatggtgtcacatacggataatcccagctactcgggagtctgaggtgggagaatcacttgaactagggaggcagacgttgcagtgagttgagatcatgccactgcaccccaggctggacaacagagcgagacctcgtcttaaagtaattaattaattaattaattaattaattaatataaataaaatagcagatttcaaaaatttgttctccctggcagcaacccagtaaagctagatctgggcggaaggtaatatggaaatataaaaactacagattagcagggatgggaagacccgccagaaatgggttcattttgtgtcctcactccctccggattctctgtgtgtctagtccaagatctaaccactatgatctgctttcctcatccatttgggaatcagggcaccacccccttgggaggcttgaatgacatgaggttgagcaggcagagcacggaactcaggctctggtgagccctggtacagtgactatgattgttgtgtcatgtaggaagggtctgttattttaccattatctgttttcaataaaaaacagaaagaaaacaaatatacaaaatacccccaaacagtaaatttcagcttcttactatgacagctagatttagcatttaacagtatgcccaaatttgaatttcggataaacaaccaataatgcttaatataagtatgtcccggccgggcgcggtggctcacgcctgtaatcccagccctttgggaggccgaggcgggcggatcacgaggtcaggagatcaagaccatcctggctaacacggtgaaaccccgtctctactaaaaatacaaaaaattagccgggcgcggtggcgggcgcctgtagtcccagctactcgggaggctgaggcaggagaatggcgtgaaccccaggaggcggagcctgcagtgagctgagatcgtgccactgcactccagcctgggtgacagcgagactccgtctcaaaaaaaaaaaaaaaagtatgtcccatacaatatcacttctcaccttcccatatcccaagctcaagacaccttatatacgccatgatttctcctgccatctctgggcattcacaccagggctcctcctgtccaggccagccttctcccttctcccacctgtgcctggtgaacaactcagttcagacatcatctcttgtaggaagtctcctgtgatcccaggctaatcaccctgatacagtcctgaaatactgctgagcagttggcatgagggcaggaaggcttggtcttgttcactcttgtatccagcttatacatggcacaaagtaggttctcaattaaaagtcaaatgaggggccaggtgcagtggctcacgcctgtaatcccagcactttaggaggccaaggcgggtagatcacctgaggttgggagttcgagaccagcctggccagcatggtgaaaccccatctctactaaaagtacaaaaattagccagacgtggtggcaggcacctgtaattccagctactcgggaagctgaggcaggagaatcacttgaacccgggagggagaggttgcagtgagccaagattgcgccattgcactccagcctgggcaacagagcaagactccatctcaaaaaaaaaaaaaaagtcaaatgaagtcgggcacagtggttcgcgcctgtaatcccagcactttgggagactgaggcaggaggatcacctgaggtcaggagttcgagaccagcctggccagcatatgaaatcctgtctccactaaaaatacaaaaaaaaaaaaaaaaaaaatagctgggtgtggtaatgcacgcctgtaatcccagctatttgggaagccgaggcaggagaattgcttgaacccgggacacagaggtaacagtgaggtgagatcatgcaactgcactccagcctgggctacagagcaagactctgtctcaaaaaaaaaaaaaaaaagtcaaatgagaccactcatggtagctggcgcctataatcccagcactctgggaagccaaggcgggaggattgcttgagtccaggagtttgataccagcctgggcaaaacagtgacatctcatctctacaaaaaatttttaaaattagccgggcatggtggcactcgtctatagtactagctacttgggaggctgaggtgggaggattgcttgagcccaagaattcgaggttgcagtgagctatacttgcgccattgtactatagctgggcaacagccagacgcggcctcaaaaaaaaaaaaattttagccgggcttggtggcatgtacctatagtcccagctactcagaagctaagacaggaggatcatttgagcccaggaatttgacgctgcagtaagccaaggtcacaccactgcactcccgcctgggagactgagtgagaccctgagtctaaaacaaataataataaaaacgaaaatgaaagtcaaatgaatgaggccaggggtggtggctcatgcctgtaatcctagcactttggaaggctgaggtgggtgggtcagctgagccctggagttacagaccagcctgggcaacatggcgaaaccctgtctctacaaatacaaaaaagaaaaaagccaggcccatggtggtgagtgcttgaagtcccagctactcaggagggtgaggtgggagaatagcttgagctcaggaggtcaaggctgcagtgagctgagattgcatcactgcagcctagccatgatgacagggcaagacccagtagaaaaccaaggttagagaggttaagtcacctgcccaaggtccgtagctaacctcagactccagcccctcagactgacatgagctcagttcaccctcttaggaacaccatctgaagaatgcatccccagcaagcctattccctatagcaaaggccaggcctgtgatgggtgccccgctcctcaccacacacctccctgtcaagtcaccactccttcacccctagcagagccaggcaccttgagcccaagggaggccactcatggaactgtcattcaaccaacagatgctgacagcaatgatgaggtgggcactgggctagtgaacagcacagatgtgttccctggcctcagaagcccacagactaaggagaagacgacagaatactcacaagggtgctggggctgggcaaaaaggtgcaggctgctttgtctggtcataagaggggaactgacttccctggtctgaggagccaaggaaggggccgtgcccttgccatgccctctgcctgccatgccttgctgttcttcagtgcctgctctaaggtcactcctagtgtggttttctctggctgctctttttttttttttttttttttgagacagagtctcgctttgtcacccaggctggagtgcagtggcaccatcttggctcacagcaacctccgcctcctgagttcaagtaattctcctgtctcagcctcctgagtagctgggactacaggtgtgcaccactacgcccagctaatttgtgtatttttagtagagacggggtttcaccatattggttggccaggatggtctcaatctcttgacctccagatcaactccccttggcctcccaaagtgctgggattacaggcgtgagccaccgcgcccggccactttttttttggagtctcgctctgtcccccaggctggagtgcagtggcgcgatttcggctgactgccagctccgcctcccgggttcacgccattctcccacctcagcctcccgagtagctgggactacaggcgcccgccaccacgcctggctaattttttgtatttttagtagagacggggtttcaccctgttagccaggatggtcttgatctcctgaccttgtgatccgcccgcctcggccttccaaagtgctgggattacaggcttgagccaccacgcctggcctctttttcttttttgttgagacagattctcactctgtcgcccccaggctggagtgcaatggcgcaatcttggctcattgcaaccttggcctcctgggttcaagcaattctctgcctcaagcctcccgagtagctgagattacaggcgcccaccaccacacccggctcatttttgtgtttttagtagagacagggtttcaccatcttggccagactggtcttaaactcctgacttcgtgatctaccagcctcggcctcccaaagcgctgggattacaggcttgagccaccgcacctggccatgctctttcttttttatttgtatttttatctgtttcttagagacagggtctcactctgtcatccaggctggagtgcagtagtgtaatcataacccactgcagcctcaaactcatgggctcaagggatcctcctgcctcagtctcccaagcagctgggactacaggtgtgcaccactatgcccagctattttttttttttttgagacagagtctcgctctgtcgcccaggctggagtgcagtggtgccatctcggctcactgcaacctctgcctcctgggttcaagtgattctctgcctcaacctcctcagtagctggattacaggtacctaccaccatgccaagctaatttttgtatttttttttttttttgagatggagtcttgctctgtcacccaggctggagtgcagtggcgcaatctcggctcactgcaagctccacctctcaggttcacgccattctcctgcctcagcctcccgagtagctgggactacaggtgtccgccaccatgcccggctaatattttgtatttttagtagagacggggtttcaccgtgttagccaggatggtctcaatctcctgacctcgtgatccgctggcctcggcctcccaaagtgctgagattacaggcgtgagccaccgtgctcggcctaatttttgtattttcagtagagacacggtttcaccatcttggccaggccggtcctgaactcttgacctcatgatccaccggcctcggcctcccaaagtgttggggttatagacgtgagccaccgtgtctggcctggctccactttcttagggagctttgcttgccctctgcttggggtagtttgtgaattcagtgctctctctctcccaggtcctgggtctcctgctcctgatcaatctgccacgtgccatttgatctcagagttgtctccaccattagactggcagggtctgtcttctggggtctgtgtgtaggatacagtggccccaggatgggtaaaggaggggacccagttgttcttctgtgataggtggagacaagggccagcagggctgtttctcggtgaaacccatggggagatagtcgaaccaggaaccaaatccggccgggcgcggtggctcacgcctgtaatcccagcactttaggaggccgaggtgggcggatcacctgagttcgggagttggagaccagcctgaccaatatggtgaaaccccatctctactaaaaaaaaatatatacatatatatacaaaattagcctggcgtggtggcacatgcctgtaatcccagctactcgggaggctgaggcaagagaatcacttgaaactgggaggcagaggttgcggtgagccaagatcgcaccattacactccagcctgggtgacagagactcagtctccaaaaaaaaaagtccaaaaattaaaaaaaaaaaaaatgccgaactcagtggctcacgcctatgatcctaccactttcagaggccgaggcgggcacggtggcgcgtacctgtaatcccagctactccggaggctgaggcagaagaatcacttgaacccgggaggcagaggttgcagtgcgctgagatcgtgccactacactccagtgtggtgacagagcgagacttggtctcaaaaaaaaaaaaaagtcctggctgtgccactaggccagacgccctagaactgacttctatggacctcagttttcatacctgtgaaatggaactcagagccatatctacttcattgggttgtgtgaatgtgaggtagttacaggatggagcaggcagaaggtcagcacagcctcagtggttggaggagtgggggtcaagtggacagagagggtaccccagggccagaggtagaggcaaggtgaagcaatgcttcatttccctgctgaggttcctctctagcagtttggaggtggggcaggagtggagaaaacacatcccctcctcaatatgggctgaggaacagggttcttgaggcaccaagaacctctttggggctctggcttgcctcctgtagtgaaagggatgggctgtgtgcaatgaactcacacctgtaatcccaacactttgggagacagagtcaggaggtccagaacagcctaggcaacatagcaagaccttgtttctacaaaaaactttttaaaaaattagccaggcgtggtggtggcacctgtagtcccagctacttgggaggctgaggtgggaggattgcttgagcctggagaggttgaggctgaagtgagctatgatagcaccactgtactccaacctgggcaacagagtgaaaccctgtgtctaaaataaaaagagggcctggcgtggtggctcacgcctgtaatcccagcactttaggaggccgaggcaggcagatcactcgaggtcaggagttcgagaccagcctggccaacatggtgaaactctgtctctacagaagtacaaaaattagtcgggcgtggtggcaggcgcctgtaatcccagctgcttgggaggctgacctgggagaatctctcgaacctgggaggcagaggttgcagtgagctgagatcacaccattgcactgcagcctgggcaacaagagcgaaactccgtctcaaaaaaaaaaacaaacaaataataaaataataataataataataataataataataataataataaagagggtgggagtggaccaaggcctaatggcatggaatttgcaaactttatcttcctagttttctctggggagccttcctccatcaccagggcccagcagggcctcagatggcggggggtggggcgggggctacacatatccctcatggccaagatgctaggaagcccctgagctggggcaacagcctctggtcacagtcatgagggaggctgggtgcagtagcgcttatcttgcctgaccttgtggagactgaccactccctccttctggaaaacgttgccccctgccctctccaaggcctcctccttcttacatcccctggtcctggctagggcctcagcacccaattctactccttgacccaccaccctgtggtgcttttgccgggccccagcccacagccatctgccaaacacctccccctggagtccctgcggcgtctctgactcagcaggtctgtgcctgcccctgctgttccccccacccagtggctctgcagagcaccctgttgcccaagccctgagtactggccactcccagggcctcgccttcccccaccaccagcaccaccaatttgaattcctatctctccctctggcctcctccctagacccaggccctgccccagggtgggggaaggaatcctacagataagggcattggtcaaagggacacacctgggttcgggcccccagctctgcccccaacctgctaaatgaccacacccctctccaaatctgagttattccctatgtaaaagggggaaataattaaactagctgggtatgctgtgctgagcaatatgtgagctcaggaaaggtcagttttccaggggaagtatggccgctgagagcctcagtctagtgcttctcattcacgagctggttggtgcctttcctaagttggaaatgggttagtccacaaatcccgttgcctggtccatgccaggtccaggtacctgcattcagggtgcagggtggagtaagacagtctgaagggtgaggtagcaggatgaatgagtaattcctgggtgcgttttgggattatgcctaagggctgtccgagcacgtgggaggggtagctaaatcctgtaagggaggggagaatggggaaggctgcctgcaagaggtggtggagggtgctttcaaaggatacctgggagtgagctggctgtaggcacagggcagctggaaggccaattttagggaagaggaaattgaggctgaaagtcaaaaaacaaaggaactgcctgaggtctctcaactgagaagtgagtgggccagggttcacattcagcccccactccattctcaggctgggcaggaaggtactttgccctcaggagggcaccttcgacccaaagcaccctgaccaagaggctgtgcaccgtggcaaccctaagactgaggcccaggtcctggagttccaccaaggtaggtacaaccagccaggccgtcagtgacaggaggatttactggggcttctagggaccccgtgaaagggcaaaaagacggcacagaagcctgtggatatcagatatagatagtgagggctagggctttatggggagggtggatgggccctgtgggcgggggatgtttaggagatcttccaaacagagcattccagcctgggggaacaacccattatagaccccacccagcaccgaagacagggacaggtggggctgagcctggaggctggcaggacctgtgcggccggctgcggtgtcagcaatgccaccgtgtgtggaaccctctgtgcctaggttcctggagccagctccacctggcaatgtgctttgtttcacaagactagagttggcccatcttgttccgcctcagatggaacacctgacctcctgcacaccccacccagcctccaaattcaaccaccccagtagtgagacagggagagtagggtgtgaccagaaggtggaatgagcttaaaataggctgcagagatatctctgagcttttaaaaagtcgtatctttcatatcgtgttcttgtgaaatcttctccagattttttacaatgactctgaaattgatcagttagcctcatgctttcaaaatccatagccgcagtgagcgagagggggcaggtcagctagaggtggagggggcagatgggccagaggcgcctgggcaggggtggatggggcctggacaggcttagtgacccttgcaccagaactctccggacaccgccccttcgcccactcgttaggctcctctgccttcgggccggctgggctgcccatcccccctcgttcccctcctgggcaggtctggactggacaggttttgggcctccaggtcgtgcagtcagtcagggaaggggcctggtgcaggccacagccaggcatccacctccttcccagcccacccctaccccccagcagcctgccaacttgctagacctgtgcggccttcccttctgctgaaagtctccagattctcagggctctgcacggggagccaagctggggcttagaactgtgctcccttgcccccacccccgacctgtgccctcatcagctttctttttttttcttttttctttttttttttgagacacagtctcgctctgtcgcccaggctggagtgcagtggtgcgatctcagctcactgcaacctctgcttcccgggttcaagcaattctcctgcctcagcctcctgagtagctgggagtataggtgcgtgccaccacaccccgctaattttttgtatttttagtagagacggggtttcaccgtgttggccaggatggtctccatctcctgacttggtgatccacccgcctcggcctcccaaagtgccgggattacaggcgtgagccaccgcgcccggcctattttaaattttttttgtagagacagagtctcaccatgttgcctaggcttgtctcgaactcctggtcgcaagtgatcctcccctctctgcctccgccgtagctgggattgcaggcacaagccatgacgccccccttctcatcagctgtctgggtctttctcggggtcctgacaccaggccaagtgttctgcacacctgacctgctcaaaacaaaaccagttctgccacagtctgggaaaatgaggctcagagaggccttgcagctgtctgtgagcaggctggcatttggatccagtgactgggttctggagcccagtggctctgtggccctgcctctccagccttatgcttctttaaaactgcccatggcctctgaagttgaggatttaggggagcagggctgccagaggggtgaagaaggagatctttctgtgggtgggtgtcagaatgaccaggcctgacactggtccctgctcccctggaaggacagcccctctcggttatgtggggggtgggctgcctagggtgctctggggagaagggagggagagaatggggctggtcgggtggggtgtggattccaggcctgcttggtcaaaaagatacagtatttcctattcccccttacactgggcaggcaggtgtggcccaggcagctctgccaggtgtgcagcccctggagaatgaccctaaagtgcacctaggctgccccctggcggcagcatgaggtcctcctccctggacttgtaaccctcccagggggaggaggtccacaccagctgatgggttggcacctgtccccagtccctttcttctttcctgtgccactgctcccagagttgcccaaaacacacgatcaggtgcagtggcttgaacgaaaccctgtctctacggaaaatacaaaaattagccaggcatgttggctcatgcctacagtcccagctacttgggaggtttaggtgggaggatcgacagcccaggaagtcaaggccgcagtgagcagtgagctgtggttgcgccactgtactccatactgtagcctgggtgacagagtgagaccttgtcttttttttttttttttttttgagacggagtctcactgtgtcatccaggctggagtgcagtggcgcgatcggctcactgcaagctccgcctcccggattcatgctattctcctgcctcagcctcccgagtagctgggactataggcgcccctcagcctcctgagtagctgggactacaggcgcccgctaccacgcctggctaatttttttgtatttttagtagagacggggtttcactgtgttagccaggatggtctcgatctgctgacctcgtgatccacccgcctcggcttcccaaagtgctaggattacaggcgtgagccactgagcctggccgagaccttgtcttaattaaaaaaaaaaaaaaaaagataaaaacctaggtaacatgctggggggtgatgagggttatggaggaaaataaaacaggtgggggctggagtgaagagtgggggtgcccctcataactctgacaaagactacaacgcagctgtcagaaaaaaagctgatttgaggcaatggtcagggaaagttgtgaaattaagtaaaaagtgatggaacaggctaggtgggaagtggtggctcacaccaataatccaagtgctttgaaaggccaagcaggaggatctcttgaggccaggtgtttgagatcagcctgggcaacatagcaagaccctgtctttacaaaaaatgtaaaaattagctggaggctaggctcagtggctcatgcctgtagggaggccaaggtaggtgaattgcttgagcccaggaatttgagaccagcttgggcaacatggcaaaattccatctgtacaaaaaaattgccaggcatggtggctcatgcctgtaatcctaacacttagggaggccaaagtgggcagattacccgaggtcaggagtttgagaccaccctggccaacatggtgaaacctcgtctctactaaaaatacaaaaattagctgggcgtggtggcgcatgcctgtaatcccagctactcgggaggctgaagcaagagaattgcttgagcctgggagacagaggttgcagtgagcctagatcgtgctactgcactccagcctgtgtgacagagcaagactatgtttcaaaaaaaaaagaaaaattagctaggtgtggtgacatgcacctgtagtcccagttactcaggaggctgaggtgagaggatcacttgagcccaggaagttgaggctatgatcgtgctactgcattccagcctgggtgacagccagattctgtctcaaaaatcaaaacacaacagggcacagtggctcactttggccttccaaagtgctgggattacaggtctgcaccaccatgcctggcctgagagtgcatgaattaaagtttctattctcttgctagtctgtcattgcttccctagtgtgtgggaaccatacttgtccccacttctcagtcagagagcagcctgccaacctccaagtctcttgcccctgacccaaaaggtcccaggctgtcctctcggcagaagcagctgtcttgtggcttactgtgctcagactccatttctaggctgtgggctcatcagggatctagtgctttgaaaaagtgtaaaggagagcagcagtattattcacaatagctaaaaggtagaaacgaccaaagtatccattgacagatgaatggataaacaaaatgcattacatacacacaatggactattattcagccttaaaaaggaaggaggccaggtgtggtggctcacacctataatcccagcgctttgggagactgaggcaggcgaatcacttgaagccaggagttggaaaccagcacagacagcatggggaaaccccctctctactgaaaatacaaaagttagccaggtgtggtggcacatgcctataatcccagctactctggaggccaaggcatgagaatcgcttgaacctaggaggtggaggttgcagtgagccaagatcatgccactgcactccagcccgggtgacagagtgagacactgtctcaaacaaacaaacaaaaaaaaagaaacgtgtggtggaagaagggaagaaaattggccaggcacactctggtaggggatggttggatgatgaaatacagacaatagaaaaacctagataaagacctggcgtaatggctcatgcttgtaatcccagcactttgggaggctgaggcggaaggatctcttgaggccaggagtttgagaccatcctggtaaatatagtgagaccccagtctcttaaaaaataataattggctaggcgcgatggctcacgcctataatcccagcactttgggaggccaaggcgggcggatcacctgaggtcgggagttcgataccagtctggccaacatggagaaaccccatctctgctaaaaatacaaaattagctgggcgcggtggtgtgtgcctgtaatcccagctactcgggaggctaaggcaggagaatcgcttgaacctgcaaggtgaggttgcagtaagctgagattgtgccgttgcactccagcccaggcaacaagagtgaaactccatctccaaaaaataaaaataaaaataaaaataaaaaagaaataggccgggtgcagtggctcacgcctataatcctagcactttgggaggccaaggtgggggcggggtggatcacttgaggtcagaagttcgagaccagcctggccaacatggtgaaacccaatctccactaaaaacacaaaaaattagccgagcatggtggtgggcacctgtaatcccagctactcgagaggctgaggcaggagaatggcttgaacctgggaggcggaggttgcagtgagccaagatcaccccactgtactccagcctgggtgacagagtgaaactgtctcaaaaaataaataaataaataaataaaacttttaaaaagtaagaagaagaagaaaaaaaatatatggaaattaaaaaacaagaaaaaaataataggccaggtgcagtggctcatgcctgtaatcccagcactttgagaggccgaggtgggcggatcatgatgtcaggagttcaagaccagcctggccaacatagtgagacctcgtcgctactaaaaatagaaaaaaattagccaggcgtggtggcgggcacctgtaatcccagctacttgggaggctgaggcaggagaatcacttgaacccatgaggcggaggttgcagtgagccgagattacgccattgcactccagcccgggtgacagtgcgagactccatcaaaaaaaaaaataaataaaataaataaatattaataataattttaaacaattaaaaaatatgggatttttttgagacagagtctcactctgtcgcccaggctggagtgcagtggcatgatgtcagctcactgcaacctccgcctcctgggttcaagtgattcttctgcctcagcctcccaagtagctgggactacaggcacgcgccaccacgcccagctaatttttgtatttttagtagagacagggtttcaccatattggccaagctggtctggaactcctaaccttgtgatccacccgcctcggcctcccaaagtgctggaactataggtgtgagccactgcacccggccaaaaaatatgttttttaaaataatagagatgaggccgggtgtggtggctcacacctgtaatctcagcactttgggaggccaaggtgggtggatcacttgaggtcaggagttcgagaccagtctgggcaacatggtgaaaccctgcctctactaaaaatacaaacctgagctgggcatggtgacgcatgcctctagttccagctactcgagaggctgaagcaagagaatcgcttgaacccgggaggcggagactgcagtgagccaagatagcaccactgcactccagcctgggagacagagcaagaccctgtctcaaaaaataaaataaataaaataaaataaaataaaataaaataaaataaaataaaataaaataaaataaaaaataaaataaaataaaataaaataaaataaataaaatagatgaaggccaggtgcagtggctcacgcctgtaatcccaacactttgggaggccaaggcaggcagatcacctgagttcaggagttagagagcatcctggccaacatggtgaaaccctgtctgtactaaaaatacaaaaaaattagccaggcattgtggcgggcggccaataatcctggctacttgggaggctgaggcaggagaatcacttgaacctgggaggcggaggttgcagtgagccaagatggtactactgcactccagcctgggtgacagagcaagactctgtctcaaaataataataataggccgggcacggtggctcacacctgtaatcccagcactttgggaggccgaggcgggcagatcacaaggtcaggagatcgagaccatactggctaacatggtgaaaccctgtctctactaaaaatacaaaaaattagccgggtgtgctggtgggcgcctgtagtcccagctacttgggaggctgaggcaggacaatggcgtgaacccggtaggcggagcttgcagtgagccaagatcgtgccattgcactccagcctgggcgacagagcgaaactccacctcaaaaaataataataaaataaaataaaaataaaaataataataatagagatgaggttttgccatgttacccatgctggtctccaactccttggctcaagtgatccatccaccttggccttccaaagtgctggaactacaggcttgtgccaccaccctggccttaaacaattattcatgaaaggaaggaaattctgacacatgctgcaacatggatgaagctcaaggacattatgctaagggaaggaagccaaagacctgccagccgaggtcccagtccgtcaagggctccagtgagcgagcaggattgagcaggtccctgggctgagcagtgggaactctgctttgctgtgagtgtggcacgggtggcggcagactgtggagtgcaggctctgtggagcaactggacactctgttgaacgaagtgcaaggtggtaggtttttgcttttttttttttttctgagacagagtctcactctgtctcctaggctggagtgcagtggcatgatctcgactcattgcaacctctgcctcccgggttcaagcaattctctgcctcagcctcctgagtagctgggattacaggcgcgagccaccacacccagataatttttaaaatatttttggaagagacggggttttaccatcttggccaggctggtctcgaactcctgacctcgtgatccacctgcttcagcctcccaaagtgctgggattacaggcatgagccaccgcgcccggccacaaggtggtagtctttctcaaggacgctggggcaaccccattgcgtcttcaccaacaccctggtacagatcctgcagctgcagtctaccccgcatacaacatgttcaatgatccctagctagacaaggcattgaaaactattccataggccgggtgcagtggctcctacctgaaatcccagcagttttggagcaaggcgggtagatcatctgaggtcaggagttcgagaccagtctggccaacatagcgaaacaccgtctcttctaaaatacaaaaaattagctgggtatggtggtgcatgcctgtaatcccagctacttgggaggctgagacatgagaatcacttgcaccaggaggcggaggttgcaatgagccgagatcacactactgtactccagcttgggtgacagagtgagactctgtctcaaaaaaaaagaaaaaaaaaattagctgggcatggtggcatgcacctgcaggcccagctactcaggaggctgaggcaggagaatcgcttgaacccaggaggctgcagtgagccaagatcgaaccactgcaccacagcctgagtgacagagtgagactccatctcaaaacaacaacaacaacaaaaatcaactattccttgggaggcagaggcaggaggatggcttcaggccaggagttggagccaagctaggcaacatagcgagaattcctcatctctacacacacacacacacacacacacacacacacacacacattaattagctgggtgtggtggcacatgcctccagatactcaggaggctgagcgggaaggatggtttgagccctggaggttgaggctgcagtgagccatgatcacgccatgacagaatgaggaccaggtggaagaactgaaaacgctggggatccacacatccgctccatcctttcagatggaaagaaataccaagactcaaaaaaatgagggtgcccaggtcctcactgagcagagactcactgctaaaaaaaagccttacctatttgggttttcactagtaagcagttggtttgtaagcagttggtgattttagtttgtctgggtttcagccatgaatattctattgtaaacttaattataacaactgcactgtaataattcaatgtcctattatgatgttgttatagacaaaatttgcctttacattgtcatttattttattttatttttcttttgagacagggtctcactctgtcacccaggctggagtgcagtagctcaatcttggctcactgaaaccactgcttcccaggctcaagcgattctcccacctcaccttctcgagtagttgggaccataggtgtgaaccaccatatcaggccaatttttgtatttttagtagatacggggtttcaacatgttgcccaggctggtcttgaattcctgtgctcaagcgatccacttgcctcgcctcccaaagtgctgagattacaagtatgagccattgacatttaatcttccttccttccttctttccttccttccttccttccttccttttctttttttgagatggagtctcgctctgtcgcccaggctggagtgcagtggcacgatctcggctcactgcaagctccacctcctgggttcaagcatttctcctgcctcagcctccggagtagctgggactataggcgcaggccaccatgcccagtgattttttatttttattttttttgagacggagtctcactctgtcaccagcctggagtgcagtggcgcattcttggctcactgcaacctccacctccagggttcaagcaattctctgtttcagcctcccgagtagctgggattacaggcacccaccaccacacccagctaatttttgtatttttagtagggatggggtttcaccatgttggtcaggctggtcttgaactcctgacctcgtgatccaccaacctcggcctcccaaagttctgggattacaggcgtgagccaccgcacctggcctacttttttaaacttaaattttaaaaaaaattaagtttatttttaatgtgatttatttatttatttattttttagatggagtctttctctgtcgcccaggctggggtgcagtggcactatcttggctcactgcaacctctgcctcccgggttcaagtgattcttctgcttagcctcccaagtagctggggctacaggtgcatgtcaccacgtccagctaatttttttgtatttttagtagagacagtgtttcactgtattggtcaggctggtcttgaactcctgaccttgtgatccgcctgcctcagcctcccaaagtgctgggattacaggtgtgagccatggcacccggcctatttatttatttattttttaattttttttgagacggagtctcgctctgtcacccaggctggagtgcagtggtgcagtctcggctcactgcaagctccacctcccgggttcatgccattctcctgcctcagcctcccgagtagctgggactacaggcgcccgccaccacgcccagctaatttttttgtatttttagtagagatggggtttcaccgtgttagccaggatggtctcgatctcctgacctcgtgatctgcccaccttggcctcccaaagtgctgggattacaggcgtgagccaccgcgcccggcctctttcaatcatttctgatgacaccggagaaggcagtgtcctttccttattgtctctttttttttttttacctgggtattctggaagtgtctttcctctgacagtgttgttggacgtggggaaacaaaagggtatcaaagagagggagagaaggataaagaccacccctcattcccgccctcccagaggggcagcctggggagtctatggaggaggtgactttgagccatgatgtgaccttagatgaggggcctctctgagcctcaggaagctcttctgcaaaatggggcaaataaagaaatgccctctgtgtgcagtggctcaggcctgtaatcccagcacttcgggaggccaaggcaggagaatcacttgagcgcaggagttccagaccagcctgggcaacatagtgggaccccatctctaccaaaaaatttaaaaattagccaggcatcaggtgtggtggctcaggcctgtaatcccagcactttgggaggttgaggcaggcagattgcttgagcccaggagtttgagaccagcctgggcaacacagtgagacccctgcttctacacacacaccaaattagccaggtgtggtggtgcacatctgtagtcccagctacttgggaggctgaggtgagagaatcatttgagccctgaagctcaagactacagtgagctgtgattgtgccactgccctccagcctgggcaacagaccaagactctgtctcaaaaaaaggaaaggtccaggcgcggtggctcatgcttgtaatcccagcactttgggaggctgaggtgggcggatcatgaggtcaggagattgagaccatcctagctaacacagtgaaaccccgtctctagtaaaaatacaaaaaattagccaggcgtggtggcgggcgcctgtagtcccagctactcaggaggctgaggcaggagaatggcgtgaacccgggaggcagagcttgcagtgaactgagattgcaccactgcactccagcctgggcaacagagcaagactccatctcaaaaaaaaaaaaaaaaaaaagtggaaaagaaggccggacgcagtggctcacgcctgtaatcccagcactttgggaggctgaggcgggcagatcacgaggtcaggagtttgagactagtctggccaacatagtgaaacactgtctctactaaaaatacaaaaaattagccaggtgtagtggtgtgcacctgtaatcccagctactcgggaggctaaggcaggataattgtgtgaacccgggagacagaggttgtggtgagccgagattgtgccattgcactccagcctgggtgacagtgcgagactctgtctccaaataaaaaaaaaaaaggaaaagaaattccatcccaaggtgatccctcacaggaagtgactcagaaaagcagtgagctacgaaagctatctgaatgaagcaagatcgtcatgtgggagacactgactacccactcctagcaaagggctcagcagcacacggcctccctgcggggatgccctcggggaagatgtggcccagaggagttttttgggccttgctcctcagtcctggctcttagtaggaccctctgcagccaaactagcatatcctgagccaggctgaccttaaaaagtaagcattcagggcctagggaccttgggcaaagcagagaagctggtgtcagatgaggtgcagcaggtacagtaggataaggtgttctcaggtcgccagtgcagccccaagatgagcctgcagtattttccttacatgatctggtcctactgtgggcagcgctgctgcccagagcctgagaggattatgaaaacatggcaacggaagtgaggccaggggacacagcatgggggcatgaggagcaggggacagcgggtggggctagaggagagggaggtttagggaggcctctgctgctgtgactgtgagccccagccaatgatgacgtggccaccgcacaatctgagttctgggaaccatgtgatggaatgtgttctgggaatagactgcagccaggaaaaaaaaagcagaagggtgcaccctcccttcctcagccaggaaaacatttctgtagcccttgcggacccaatgcgcagaagtgagagggaggaaagccaggctcatgtttccttggttgtgcttcaacttctaaaatatgttttttctatgaacattttaatgaggggttggacataagacagaaaaataacattctgagagctcgtttggaggttctagcaggggagcgcagctactcttatactcttgactgaagaccgatcgtcctctatcggggatggtcatcctcttccattgagcacacagcttctggagggacgcacatggagtggtgagggaggaaggggatacccgcctagtcagccagatcagccgaatcaaccctgatgatcaatggggtgacacatgtcgcagccagatcaccctcacatcccaaaaataacactcagattgctttttcttttttaagatgtagacttttcttgagactttcgtacaaggcaatggacagataaccttaacctcccagagaaaacacacattggccacagaaaaaggcgcttctccgtatacctgccatagttatcagcaactttgaaatggcttctcagactctcaggggttggcttgttgtgtttgcttttgcaaataactcaggcttaagtcctgctactttcagagcctaggggacgcttaaggactaccatcagtttaacacagtggcacttggagcacatgctacttatggtggtgaggaggggtgctggtgtgagggtctgaacgcttgcttctcctctggcagggtgtgagcagccagaggccactacctgggcaaggatgcttgctcagtgtccatggagggacatgtgatccagcaggtgggcaggaaccaggcccctgtggccgcccaactctccataatagaatccttggtcatccatgggcccgtaaaccatgaccacgtctcctgccctcagcgccagcctgcccttcccctggccccccatttgcccatccccaggatcatagtccagagctgctatcatgatctttggagtccacagtgggagtctcttggagttcccctggagcaccagggaggaaccctgggggatggtgagcccctgaaagtcctcgaggtgggccacagaaggcaggttcccttgggccggagaacgccacctcctatcagtctgctctgtccccacctccatctcagccactaggcgcccggggatattgcccacttgcctgttgcactcgctgaggtagaaatcatgggtgtcctgagagccccacactcttagcaactgccttttctggaagaccagctcctcctctgcagccttgaggttggcagacatcaccagggggttgtaatcagagagggccacaaagaccctggctggagtgttggcccccgtccccagctgttgggggccacccctgggcatcttgatgactttggcggatggagctggacacagtgccgagctgggctcatggagctggcaccctctcttcacccccagagcttgtccttgcctgctgtggggctcaggctccctcctctcctctcgcctctctgtgccccacagatccaagcacagtgcctcctgctcctccttcaaaacgttatggaagtcagatgcatactgttggctggcgcccagctggggaggtgtgaacccttgggcatcttgcttttgccgaagtaccctctcaagggcagccttttcctgacacggttctttcctgggcccacactcggtgcgtagatggatgaatcctggagcagggcttttgctggtgcccatgtgctgggagcaattttccttctccccaggctggtcactgactgaaggtggcctgtggttctggggactcttctgaaagagcaggtcctttctacagccctcccaggcctctgcaagctcctgggcttggctgccagcccctgaactcggacattctccttctgagcccaggttggacactggggattgcctccttgggggttcttcaaagaatgcttctaggaacttggcctggggctccccgcagcttccagggttgtgggggctggccttggcactcggaggagccagtgacagcttctgggggcagacggggaaggtgactctgtaggtggatgggtcgccacaagtgtagctaaagggtggagtctctggccatcggtgacacatgaagaagtcctcggggatctgagcaggcactgaatccagggactcaccacagagtgacatggttctcactgagaccttctgccacgtgaggggcacctgtagctgggagaattccaatagggtgctcccagcagtggcatcggcgacctcacaaaccttaagcccatctgcatacacagcataaccggtgacctggactccattggaggacccagctgagtcaatggtcacagggagccagctgaccaccaggacacctggcgaggcatggcgctccaccagcacatccagcggtgggtagggaggtcctgccaagagtgtgtcgaaggtgacggtggaggacatagttccccaatacacctgcagcaagtcccgtggcagccgcacctccacccgcgcccggtagtgcgtgccggggcacaggccctggaaggtgtagcagctcacgcccgctggggtcagggcatgctctcggtcatcaagatataccacatgggggtggcggtggctgctgtagacccaggtgatgttggctgatgtggctgtgacattctgcaggtgtagctgcatgggagccatacggagcacccctttggtccccagaaggggtctggagaggccctgcttccccatgctctgcagcaagcccagctggcaggcttccgtcttggtatccaggatctctgttgctacttctgtcttggagcccaccctgaccatctggcacagccctctgtccaccactccctgggctttcccagataataagctgtcttcctccagagcttcatcctgccccgctgggagttgactggggccaagatcaggggatttggcaggcaggcagcctgggatgtagctgtccggaatctgctccacgaagttggagggcaccagcccccgccggccatcctcaagctccccctcatagaagccatcctcatccatgtccccgaagatatatatgtagtccccagctgtgaggggcagctcaccctcagggtgatcattgggcccctcaaatgggttgtagttatactgagccatgaagatcttgagcttgggggcagcaggagccgccgagccccccatttccagggccagggacacgctgtcaggctccaggtcatccacctcactggctgtgtccctgtccagagtaggggaggacggcacggtggcccacatcgacccctcagaggaggagtttgactgggagctggttttcttggacagaggttggctggcagggactgtctctgaaacttgggggacactggctgactccccaagggcaactgggctctcctcgagggaggcttcccttttctcctgtatgtctctgttgggctgtgacactgcgtagtcttcaggccgtgcgtggaacttgggccttctgctacctttaacttgggactccggcatttgactggtctcccagggctgttcaggagggtgaccaggccgacactggagcgcctgtatctccttccaggaaggatggaggtcacacagggccttctgcgggtcgcgttgcagctgctgctgcctgtcctgcccgcgcgccgcctgctgcagcagctgttcggcgatcaagccggaggcatcgcgctcttgacacgcgcggcccaggtggccgcgcacttcgctattctcagcctccaccttccgcacccagtcggtcttggcctgcagccgcccattctcctccgccagccaggcgtttttgagcagcgccgcctgcagctgtgtctcggcctcctcgccacgtcgccgcgccggggccgcctgcgcgcccagctcctggcactcgcgccgccgctggtccagctcgcgctccagcgccagcatctgccgtcgcacctcctcgcaggttgcgctctggccgcccgcctcgggccaagcgccaccgttgccctgctgaagcatcaactgcctctgcaggcgcagcacttcccgctgggactcgcgctgcaggcggtctaagtctctgacgttgagccactgggtgcaggggccgccccttccagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggttggtctcctgcagcttgcgggcgcggtcagctaggcgccgcgcgagcccggtcagctccgcgcgctttaccttgagccgcttcaccttctcgtctgcctggtaggggcagcctgcacgccgcagctgcttgttctccgcttgcagggtataacagcggcgcgccagcacccacaacgccttggccagcagccagttcagctttatcagctcgtggtggcccaggcccgggggtgagggagtcaggacttcgcagggctggctctcagagccttctcctccccgcgggttgctgagtttcctgtgggctgacggtggtggtggcggcgggagtggcgatggtggcggcgagagcctccgggagccaggggtggaggtgtctggtgaggagggccgctcctcggatttggaggccttggggaggctccgggtgctgtcaagcgagcgggaacacgcaggtgcgaagcaatcaagggagctggcgtgcgtggagagcaggccgtctggggagctggagcacgcagaggacaccaggcctagcgagcgggagcgcacaccgacttcagcactcaggctgtctagagatccgagttggcaggcgggtttgggggcgtggcaagagccgctggaggtctggggcagcggttcttccaaggaatgcacagcttgggggtccggtgatcccgacaaagccgggtgcccgcggaagtgcgccaggatgtacttgaggaagagctggcgctccacctccagcgccgcctgcagatagcggatgcgcgccgcctgctcgccgtcagtctgccagcgaagctgcgccaacacttcctgcaggcgacagcggcactgcgccgcggaaacctcggacgcccccgggcggctacagtggccgcggttcaccagctcctcggccagctggcgctgcagctcccgggcttggcgcaccacgccatcgcgctcccggtgcagcagctgctgcagctgccgctgctcggcctccttccagcgcagcagctgccggatctcggcctcgcgttcccgctgcatctcctcttgcagctgccgcaactcccggctgcgctgtgcctcccacttggagcgcagacggtcagccagctgtcgccgctcccgctcggcctcctcacgcagctggcgctcccgggcagcgaagcgccgccgttccgcccgccagcctgcccgctccgcctccagctccgcccgtagcttctccagctcccgcctctggttctccagcactgccgccgccgggctggagcagcccggcttcttgggcgacgcgcccaaggggctgggcgagtccttggccattgcggccgcggcccggctggtctccagacttcgcctggcaggcctcagctcgccaacggccgccgccgaccgcccggcgcgccccttccggcgccccctgggggtctccgcgtgccccttccgcctcttggcatgttcccccgcctcctgccgcggatgtctggcccaggcgcctctccacctggcaaggccagggctggactcccacacccctgctcaaactggcccatgtcccttccaggatgcacgggggcttttccggtccctacacttttcctgcttctagcaccaagtcccttgtgaccctccccaggcaccctcccaggcactgtgcagtcccaagcaggccgcggtgccccgagggaagtctgggctgctgctcctgtacttggagaaaggggcagggtgtgtgtgttaaggccacccatggggtgtgggcatacctggtcgtgggttcaggtggtgtatttgggtcaggtggctggaaaatgcagcaggataggcctcaacttggctagacctggactccccaggacccttcagccccctaacagccctgatcacccaactggtcatccaccttttgaggaaaggatgtgcctgatacacatttgtgttactgcgcagagtcggctcagaggaggtgtaagcgaaaagaccctccccagcaaggtggcatagggacccagggccagataggcatgaggggcactgcccaaactggccatctggcctgtctacctcccacatccaggtaccacctggtgacaaacactggagccccagtgtctgggctactcattggcatcttaggtagaggcctcaggatgggccaggagtgagggtgaggcttcagcagaaatgttggaggcatcctgagctgcagaagaaacacacacacacacacacacacacacacacacacacacacagctgcagaagaaacatacacacacacacatactgagctgaaggaatacacacatacactgagctgcagaagaaacatacatacacacactgaactgaagaaatacacacacacacacacacacacacacacactgcctctctgactggtggccacctgtgtggcttgggagctaagaagccctgcttcagtctggctcctctttgcccttcctgtctgctcctggtgccaagtggcttttgggagacatggatggacacctgatacctggcagtctgcatcgagacattgatttttttttttttgagatggggccccactctgtcgccaggctggagtgcagtggcgcaatcttggctcattgcaacctctaccttccacgttcaagagattctcctgcctcagcctcccaagtagctgggattacaggcttgagccaccatgcccagctaattttttgtactttttagtagagacagggtttcagtatgttggccaggatggtcttgaacttctgacctcaagtgatccacccgcctcggcctcttaaagtgctgcgattacaggcatgagccactgtgcccgacaagaccttgatattgaagtcacatcagaggcccctttgcttcttggtctgtcgtgtctccctgtccccaggaagcacctgggacctctcacaactgctgtgttcactcagcttatggccctcctttacaacactcaagtttttcaaatcagtttccccggaacccacagaacatgcctttaggcagtgtcaagtaacaagaacatcgggaattatggctccagatgttcttttttttttttttttttttgagatggagtctcgctctgtcgcccaggctggaatgcagtggcgcaatctctgctcactgcaagctccgcctcctgagttcacgccattctcctgcctcagcctctcaagtagctgggactacaggtgcccgccaccatgcctggctaattttttttgtattttcagtagagatggtctcgatctcctgaccttgtgatctgcccgcctcagcctcacaaagtgctgggattacaggcgtgagtcacggcgcatggccctttattttattttattttattttattttattttattttattttatttgtgagacagagttttgctctgtcaccaggctggcatgcagtggcacgatttcggctcactgcaacctccaactccctcgttcaagtgattctcctgcctcagcctcctgagtagctgggattacaggcatgcgccaccacgcccagctaatttttgtatttttaatagagacagggtttcatcatgttggccaggatgatttcgatctcctgaccttgtgatccgcccactttggcctcccaaaatggtgggattacaggcgtgagccaccgtgcccagcccagatgttctttatgagaggtgaggcagatgtagtgtgtatgtgagaggaaggggaggtgagatgcagggatggccttagccttgaactggtgctgggctcctgggcatggtagccacagggaggactatcttgagagaatcttcatcacagccctgttttacggaagagaacctgaggctcagtgagagccactggcttgccagggcacatgggcaactgaggcagagctggtgggtggggtttcacagcctggatgccctgctgcagtctccagtagggcctcaactgtcaggtcaggagggcaggctgggccgggcatggtggcacagacctgtaatcccagccctttgggtgaccagggtgggaggatcacttgagcccaggaactcaagacctgcctgagcatcatagagagaccctgtctctacaaaaaaaattttagctgggcgtgctggtgcatgcctgtagtgccagctacccaggaggctgagatgggagggtcacttaagcccgggagtttgagactagcctgggcaacagagtgagcgagacccagtctgcatttccagctgagatgaaatgattgcttgagcctgcaaggtgaggtcaaagtcgcagtgagctgtgatggcaccactgcactccagcctgggcaacagagcaagactgtctcaaaaaaaaaaaaaaaaaaaaaaagcctggtgcggtggctcactcctgtaatcccagcactttgggaggccaaggcaggcgtatcacgaggtcaggagatagagtccatcctggctaacatggtgaaaccccgtctctactaaaaatacaaaaaattagccattagccaggcgtggtggcgggcacctgtagtctcacttatttgggaggccgaggcaggagaatgacatgaactcaggaggtggagcttgcagtgggccgagatcccgccactgcactccagcctgggcgacagagcgagactccatctcaaaaataaaaattaaaattaaaattaaaaaaagagagtaggctgtcaccaagaaaaaggacactggggtggatgggtctctgggaaccccacagttaccatccagcagctgccccaaagtatgtcaaaagcattcgggaatgttggttgagtggatgagcaaagccaggcttccccagggctgggtttctgccatccctgttctcatcatgttgtgcagtgattgtccagtgacctgcctgtcacccccatcaactctgatcttggggagagcagaagccatgttttcccttgtccctattgcatccgtgcatgtgacttagcacatcactggtgcccaagacatatgagaatgagttgcagggaggcaggagtccctgcatgagctcaccatgctgctgccttctccaggttcaactttctcacctattaaatgaaagagatggtttcttttttttttctttgagatggagtctcactctgtcacccaggctggagtgcagtggcatgatctcggctcactgcaatcttcacctcctgggttcacgtgattctcctgcctcagcctctcaaatagctgggattacaaacacctgccaccatgcctagctgattttcatagttttagtagagacaaggtttcgccatgttggccaggctggtcttgaactcctgacctcaagtgatccacaggcctcagcctcccaaagtgctgggattacaggcatgagccaccatgcccagcctgaaagtggtggtttcaaactgggttctttagggctccagggttccttggaaatatagaactgctgggcacacacctatactcccagctacttgggaggctgaggcaggaggcttgcttggatccaggacttctggattgtaatgtactatactgatggggtgtctgcactaaacttggcataaattggtgacttcctgggagcaggaaaccaccagcttgtctaaggagaggtgaactggcccaggttagaaaaggagcaggttggccgggctcggtggctcatgcctgtaatcccagcactttgggaggccaaggtgggcaggtcacctgaggtcaggagttcgggacccgcctggctaacatggtgaaaacccgtctctactaaaaatgcaaaaattagctaggcattgtggcgcatgcatgcctaatcccagctacgcggcaggctgaggcaggagaattgcttgaatctgggaggtggaggttgcagcaagctgagattgcaccactgcactccagcctgggcgatagagtgagattccatctcaaaaaaaaaaaaaaaaaaaaaagaaagaaagaaaaaggaaaacgaaaaggagcaggtcaaaactcctgtgctggctgggcgcagtggctcacgcctgtaatcccagcactttgggcagttcaagaccagcctgaccaatatagtgaaaccccatctctactaaaaatacaaaaaattagctgggtgtggtggcaggcgcctgtagactcagcttctcgggaggctgaggcaggagaatcgcttgaacccgcgaggcagaggttgcagtgagccaagatcatgccattgcactctagcctgggtgacagtgcaagactccatctcaaaaaaaaaaaaaatttttttttttgtaggctgggcgccgtgactcatgcctgtaatcccagcactttaggaggccaaggtgggtggatcacttgagatcaggagttcaagaccagcctggccaacatggtgaaaccctgtctctactaaaaatacaaaaattagctgggcatggtggcaggtgcctgtaatcccagctactcgggaggccgaggcaggagaattgcttgaacccaggaggtggaggttgcagtgagctgagatcacgccattgtactccagcctgggcaacagagtgagagtctgagtcaaaaaaaaaagaaaaaaaattaacaacaggccagatgtgacggctcatgcctgtaatcccaccactatgggaggctgagacgggcagatcacttgagctcaggagttcaagaccagcctagacaacacggcaaggctgcatctctataaaaaaattacaaaatttagcctggcatggtggtgcacgcctgtagtcccagctatttgggaggctgagatggaaggataccttgagcctgggaggcagaggttacagtggactgagattgtgccactccacttccacctggacgagagagccagtccctgtttcaaacaaccaaaaaaacaaaaaacccacccccccaaaataaaaacaataataataataaaaataaataaaacagaaataccataggccttttgggaggaggtatgcaggaagcggatggggagagacagtgcccctacttgcttcaatgggcagatctactctttttttttgagacggagtctcgctctgtcacccaggctggagtgcagtggtgcaatcttggctcactgcaacctccgcctcacgggtttatgccattctcctgcctcagcctcccgagtagctgggactacaggcgcccgccaccgagcccggctaatttttgtattttttagtagagatggggtttcaccatgccagccaagatggtctcgatctcctgacctcgtgatccaccctcttcggccttccaaagtgctgggattacaggtgtgagccacagcacccggccggcagatctactcttaagtgtcacttatcagattcgaagaagggttttggtttaataaagcgttatgctccttgaaacaagtttcagaacccctgggttagaggacctcttgcccattgtgtgctcacacacacacgacacacacataccccatcccagtacgtaatgacttccctgacccggagagaaggcgatatgtcccccttacatctcagttggctccacatcgccagctctgtattccactttccctctctctacaaccccagtctatgacttttgggccatggagtctgggttcctgggcaacctggttcacatccttctcctgccggcatggcctggctccatttctgttcggctaccaaagccccaagctttgtggagcctgcctggccttgaggaggggaatgggctccatcctgagagcctgcaggagggtttaagcttcccatcccccattgctacagtagctcccccagcttttcattccatatcctttatttttatttattaaaaacttaatttttggccgggcgcggtggctcacgcctgtaatcccagcactttgggaggccgaggcaggcggatcacgaggtcaggagatcgagaccatcctggctaacacggtgaaaccccgtctctactaaaaatacaaaaaatagccaggcgtggtggcgggcgcctgtagtcccagctacttgggaggctgagggaggagaatggcgtgaacccgggaggcagagcttgcagtgagccaagatagcaccactgcactccagcctggcgacaaagtgagactccgtctcaaaaaaaaaaaaaaacaaaaaacacttaatttttttttttgtagagacagggtctccctatgttgcctgggctggtctcaaactcttaatctcgagtgatcctcccacctcagcctcccagagggatgggattacaggcatgagccaccatacccagccacatattttttatttttgtttctatgtgttttctgtctgttctttgctgtctcctccatgtctagaacagtgcctggcacatgataggtgctcagtaaatacaggactgaagaagacagaggcagacaggccagatgtggctgctgtccttagggaattgacagtccatgatctatgagaatgagctgcagactgggaggcaggtgtcccagcatgggctcaccaagctcctaccctctcccggtccagctttctcacctatgaaataaaagtgaagctggacatggtggcccacgcctctaatctcagcagtttgggaggccaaggtgggtggatcacttgagatcaggagattgagaccagcctggctaacatggtgaaaccccatctctactaaaaaacacaaaaattagccgggcgtggtggcagttgcctgtaatcccagctactcgggaggctgaggcaggagaattgctttaacctaggaagtggaggttacagtgagctgaggttgtgccactgcactccagcctgggtgacagagcaagactctgtctcaaaataaataaataaataaacaaacaaacaataaatgaaagtgatggattacatgaatggttttcaaactgggttcctcagggctcagtttgggggagaatgcaaaggttaaatacaaacaacaatggaatgtagtaacattggcgcttgggcgagtgctctgggtgaggaatgtggtgctcatggggagaagagccgcatcagagcaggcttcctgcatgaggcaaggaggaaacacaagagctgagagctgaaggagagggagtgagggctgccagaggagctgggaggcgatttcaggcagtgggaactggagctgcaaacccccagcctcctgcagtctggctatctgtaccagccctcacccatgcccaccaccctcagggcactcacatcccttcttgcactgatattttcccgtcctatcatgaccctcgtttgagggtgcagggaggactggagctcagagagggagggtcacctggccagaccctaacccgctgagttccagtggagttccttccatcccccagcactggatggggctggatacctggagagggaccgtgctgctcttcctgggccctgcagcctgcctggctggtccacatcttcctgggccaggagggcagtatggtgcgagcttctagctctctggctggggccccctggcctactgggctggcttcctgccctggtggccctggcccagctccccagctcatgtgcctctgcagcgagtggtcagccccttcccatctgcactttacaagcctcatcgctgaatcctccccatagccagagagcctggcactctcctctccagagaaggaaactgtccagggtcacacagggacttatgggcaggtctgtgtgacctgagtctgggctctgaactggtgcttgcagggtcttgccctctggctctggcagcctgagtgttactgtaatccctgagcctttgaacaagcaggcactgcttcctgagatccccattgctgctgtcagcgtctctgtttcccagctccacactgctgccaggacagacgtatcttctgtcttgtagcatctccatttctcttccctttagatctatttttttttttttgagatggagtctcgttctatcatccaggctggagtgcagtggcacaatcttggctcactgtaacttctgtctcctggattcaagcgattcttctgcctcagccttccaagtagctgggattacaggtgcatgccaccacgcctggctaatttttgtatttttagcagagacgaggtttcaccacgttggccaggctggtctcaaactcctgacctcaggtgatctgcccacctcagcctcccaaagtgctgagattacaggcatgagccaccgctcccgggctggatctatttcaatcaccctccttcctctgcagcctgaaacttgaggctttgcccacttcccaaaggcacgagtagcaatgaccatttgttctgtcatttggccatagctctaggtcagaggacagtccttcatcaaatgtttgttaagcatgcaatctagacaggggaggacaagggccaagtaatgtgttaatttcttcattcactaagcacagagaatggagtagaaggaaggtggaaaggagaaggaaggaaaagagagaagaaggaggatagaaaggaaggaaggtgggagggagaaaggaaagaaagagggagtcctttaggttatctaagtcccctcaggacttggtctggccctcacagttcaagaacagacttgggcttgagcctctgaccagccagatgactgagaagctgaggaacagcttgagcctcagttttttcctctgtaaatggggttgatagcagttctgacccagcgggctgttgggggagtcacagagatgctgggtgctgcctttgcactcagaagggtccaggctaggtgtggtggctaacacctgtaatcccagtactttgggaggctgaggtgggagaatttcttgagtccatgagttacagaccagcctgggtaatatagagacaaactgtctctataaatttttttcccaaaaattagccaggcatggaggtgtgcacctgtagttctagctgcttgagagtctgaagtgggaggataacttgagtacaggaggttgaggctgcactgagccatgatcacaccactatactccagcctgggtgacagagccagaccctatctcaaaaaaaaaaaaaaaaaaaaaatcaaaggggtccagcagcatcttcctgtcagcttacctaagggagcatgataaattgagtccctgccacgatggacatggggagtgtagtgggagggaatggcaaaggcaccacaggcagagggaacagcctgggcatagtggggggtgtgatgtggcacagcactgattgtgggaagcgagggatgtgggagatgaggcttcaggtagtcagagggaggttgaggcaaagcctcacctgcatgctctagatgaggtccaattcctggtacccagctcctagcctagtaatgggccacttctcccagggccacagttttctctcctatcaaatggaacatgttagcactgctctatggtgccaatgaagggtataagtgtccagtgcccatttcctgccccagcaaaggcactttcttttccttgtcctcttgcctactggggaactccttccatccctggttcctcccccagcttctgcgaggcccctcctctgagcccccacacctcatcaaaccctcaacaccgtctggtgttttccttggtgcctcttcaagatgctgtgagctccttgggggcaggtggtgcctgtgtacctcttttttttttcttttttttttttttttgagacggagtctcgctctgtcacccaggctggaatgcagtggcgcgatctcggctcactgaaagctccacctcccgggttcacgccattctcctgcctcagtctcctgagtagctggtactacaggggcccgccactgcgcccggctaattttttctttttttctttttttttttttttgagacggagtctcgctctgtctcccaggctggagtgcagtggcacaatctccgctcactgcaaactccgcctcccgggttcacgccattctcctgcctcagcctcccgagtagctgggaccacaagcacccgccaccacgcccagctaattttttgtgtttttagtagagacggggtttcaccgtgttagccaggatggtctcgatctcctgacctcatgatctgcctgcctcggcctcccaaagtgctaggattacaggcgtgagccaccacgcctggccttttttttttttttgtatttttagtagagatgggctttccctgtggtcttgatctcctgacctcgtgatccacctgcctcggcctcccaaggtgctgggattacaggcgtgagccactgcgcctggccctgtgtatctgtttttctggaccgccatcatgttcaggaaggcatcgaatattttgtccgcgactgcaatcacacactgcatcatccctgaaacgaggtttccacggataaggtgcagcaacagagagagaatcctagcaactttcaatcattttcttttgaaatggttttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctctgtgtctcctactcccttccaatatgtggtgactccccagtctgtcaatgtcttttgtgactttgacacttttgaagaacagttattttgttgaatgtcccctaatttaggtttgtctgatgcttgcccatgataagactagggttacaggatttgagggagaactccatagagtggatgtgccctttctttttttctttatcatttttttgagattgaaactcgctctgtcgcccaggctggagtgcggtggcacgatcttggctcactgcaacctctgcctcctgggttcacgccattctcctgcctcagcctcctgagcagctgagactacaggcgcccgccaccacgcccggctaattttttgtatttttagtagagactgggtttcaccacattggccaggatggtcttgatctcctgacatcatcgtgatccgcccgccttggcctcccaaagtgctgggattacaggcgtgagccaccgtaaccagcctgccctgcgtaatttttgttgtcgatgatccaaagtgcacccactcgccatctctggtagctgggaggagcaggtttttgggtgaaggtgaaagagccggagttggggatgtgtgtggctggggggtacaggtgcgaccactttgcagtccactcctgtgagtagggcattcctgagggagagaaggcctggttagccctggggctccttcaaggcctggccccaggccttgatacctagagcagcctgacacatgtgtggatggactgccaggcggtccccttaggaggggctgttctagcagggaccctggcttgggtgaccaccacctcctgccacactccaggatccctgtccctgctggaagccgggcccagggccatgccagccgtgaggggttcctcatgagcctcctccccgggacccaggccccatgcagctgccccctcccacctgcctgacccccctggcctgcacttccctccatccgaatcctcaatctccgcctggaattcccttccctcctcaaccccacctggaaactctcctcctcctcccacacagctgggactccctttctcccacctctgggggcccaaagctctggatgccaccctagccctcagctggcctcacctgtctcctcatagccccacagcttgatggtgtctgtgtgggcagcgcctcaacgtgccaggtcaggctgaggttgcctgaggtgttggcggtgccgtagtattgccaatgcatctcgttcatcaactcactcttctccttcatcaacactttgttggggtgcactgggcaggggaggtgaggggtgagtgagggctgggcccagggaagcagggaggaggccctgaggcttcaagggctgtgggagcctccagggccaatgcatggcagcagctgggtgatggtctctccggccctcatggcagaaaaggacgctgaggccggagaggcaggggcctgccctccctccactgcccacgcctctagcctccacctggcttctcccctgccctggtgtggcggagctcagtggataggcactggcccacctctctagggacccctgcagctcccactcactctgggctgggaccgtggtctggatgccagggagtggaaaggagctgaaggaactctcgcaggcgggcaggcctcccaagggattggttcagccagagaggcaggacacggacgggccaagtctcggtgtgcatagattagcgctggggaaagtccccgtgggggcaggctgtgggcagggaggagggctcaccagccagccaagtgcccgcacgagggaaggagtggccatcgtccagtgagatggtgaaggggacgtggccgctctcatagagcaggggcgacacgaagtgcacttgcccggaggagtccacatggccgagggtctggatgctctcctgtggcatgcaaacctgtgggcctggtggtggtaggaggtgctgggccactgcaggctgagcatctcgacagtctgggcccccaacctccctggggaacccatccaaccagctgtcctgtgccctcctgcctgtcctgggtctgaggggctccattcagcctgccagtgggtctgagccctcagcatgcacagggatgggggcgtggggccccagtgcccggcctcctgggcctcccaacctgcagatcacactggtgtctgtggggctggacatcttgaagtgccgcaccacaaagtccttgccgcccatcatggagactgagtagggcaatatctccaggcagaagtcctggaaatccaagcagcaggtaccaaggccggagcacgtcgggtggcaggaacatggcctgtccagggcgccacagcgcatggagcagctctcttgggcatctggaggagaggatgctgagggcctggcctggcgggtgctggactggctgccccatgtgcagggcctgtctctgtttctcccacagcccattagacagcagcatccccaggaaaatgctggccgggaactgcacaggccaccacgttgatatggtagaaagtcacagggcccgtggggatgggatgaatcttagcatagaccatctggctgttgccctgactgatgggctagaatgcagcgagaagaggcaaaaggctgcacccgctcagccctgcagggtcaggagaagccccctgggcatgactgcccttcagccaccaagtcctctatcccacaggcgggggtcctcagagggccacggtagctggagccctcgacctctcttggctccccagggtgtctgtgaacagtgcgccttctgggggccctgaagactgcagaagaaccccttttgcttgcctggactggggtgggggatacagctgccaagagtcccattcgaggcctggtagggaatggtgcagggtctgaacttgacccttctcactctcccaggggctgcaattgagaccccaaagagagctccgccctcagggcagaaggccagggctgctcccctcctttctggggggaggagggacatttcaagcaggtgtcccagcagtggggaaagggaagtgggggtgcacactgcgaggggctgtgggtgctgggcccaaagcatctcctatgggccatgacacccacggcagggccacatttccagggactggcatggaggaagagttgcagggagggactggggcaggtgcgtgcccagctgggggccctgaagggagacaggtcccatccccgggctccagagatgccaccacccagggaagccttggctgtcccagccacacctaatcctgccgctcagagtttgcataatttaatcagtgttcacctcccttcttgagcagatgaggaaactgaagctcagatgcggacaggcaaggccgagccaggcccttggtggcttctgggagcccctgcagccagggcgggtggtaagggctgtggcctgggactggtcacttgggccctgccacctgggctggacgtccagacaggcgggtggtcctctcccagctgcagcttctcaaggtgtccaaaagggacccttgccacacttgcagggagtcagagctggccccagggcatgagcttaggccatctggtctgtgatctgccccagcgcttgcggccaggccagcccattgttccccagcctgttctctctcttgcctgggtggtgcctgctgggaaccacagggtgttggcagccacccatggctccagagaggtgggcccctactgaaagtgttagaggcatgtgctgggggacttggctcctgagtccccacacagagctgttccagggaagccacacccgcatttgatgtcttcccacctcccaaagacatttggtgagaggcccccaagaccttcagcttctcaggactgtttccagaggggagaaagtcccttaacccacaacggtgctcagggtacctctgcaggtgagtgtcctgtaagtggatgctcaggcgctgagccacggagagcctgtctcctggccccaggctggcgagggcattcatcccaggcccagggctgaggttgctccctacagcactgggtgcaggtgtccatcctcctgtaggtgaggctccgggtggttcgtctgagacagttcccaggaactggaggagggagagctgctgcttcctgtttctggcctgggaacccttgctgtgcgtgtctggagacgatggaagtccggtaggggctaggtgtgcagtctgggaagctccataccacaggccctgccgtcagctgagtaactgaggctggctcatctcagccccccaaaggtgggttcagccagacccatatggggccgccaagcctctggttccaaaagggcagtgcccagccctttaggcctttcttcttgggtggtgggtgtgtccagcccatgaggggcacagggcagtgaggagggtccccatctccatcctggacagagagcctgctccatgggaggtcccaggggccaggagggcccctgtggtgctgggaggggaagagagttgtgaagggtgggtttgggtccctggaacctgtgcatccccaagacagatgggcctggagccttcgggggcggggccagctctaggggcttgtttaatgctctgtggtggctgccttaaaatacttaatcatttttggtcaggcacggtggctcaggcctgtaatcccagcacttcgggaggcctaggtgggcggatcacttgaggtcaggagttcaagaccagcctggctaacatggtgaaactccgtctctactaaaaatacaaaaattagctgggcgtggggacatgtccctgccccctgccccttgtgcccgccctctccctccccctgccccttgtgcacaccctctgtaccccccttcccgccccagcctgtgtttgcagtgctacagggtggctgcagccttcgcctcccacagctcctcaaggtcagagggctgggaacccctgggatgtggctgggatgaggaccctgcccctcgtcaggcatttccaggcaaggggcacagagacacagccagcccagcagctgagcccctcctatcaggccaggtgggaaactgaggcatgaacacaaccccagactggaaataacaaagccatcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactagggccccacacaccaggaggaagaacccagtgcagagagtgccagcaggaagccacaggggcagggaaggcgctcctgggagggtgggtggctgcgtcctgaggctgagcagggggagccggcctagggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgaggacactcctgacacagagaccccagcccagctggcaggggaaggggagccctcaaggacccctgtaggttggggcatgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcggaggttgcagtgagccgagatggcaccactgcattccagcctggtgacagagtgagactccgtctcaaaaaaaaaaaaaaaaaaagaaaagaaaaaaagaaaaatgacacttgccaaagcgccgtagggaagactgtccaggaccgtgtcactaggcataagggaccacggcgatgagattctgcagtgggtaagagactgggctcagcctcgaagacagcatgggcaagtgggatcggaccgtcaaggagcagggggaagactatccaggaccgtgtcactaggcataagggaccatggcgatgagattctgcagtgggtaagagactgggctcagcctcgaagacagcatgggcaagtgggatcggacagtcaaggagcagggtggggggcagtgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcagaattcttgctaaaactagagtttataaggaagtgctcagatgtgcctaggagaaggctcaggagcctaaataaagcttgaccaagcagagaatctttgtcaccagcttggtgagagtgaggcccagagtgggtcagggcttacctgctcaggttgtacaactgggaggggtccgtcaggagcctggagtcttcccactgggggctgagtctgggccctcagggcacatataggtagatgctgtcaggcccgacaccccatgcagtgcagactgggatgctggtgcctgtggcacagactggtcagacccaccccaggctagacattccttgcagggagagctgaggctgttgatgccaggaacagacaaacaaggtcatcaccaggtaatgagctcgttacccacatcaggcaaggccattgctgggtaatcatttggcctcctgcagagccacctgccctgggacggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtcggggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctctgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacagggtccccaggaccccgctcccattctgcccttgctcctgccaacctgtcttctctatgcccatgactttgggaccctctgccataagtaccagcccccacatctgtagcctctgcaggaacaagccctaatctggactcattgcaatggctcaggttctcttccagcctgtccatagacctccaggcagagatcacaaaactaacagctctttctgcaaatctggactctctcctgcaccttcgccaccatccaggcctccctgtcactcctcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcagagccagctgctggaggtcccagaggacgggtgactcagcaggaatgggggagtctgaggggttgacagagtgcccaattctcacctcctcctgcaccttccagggagacgagctgcagggagtgattgagtggatgaacatgactagagggacccagtcttctcctcagcagctgcttgaggacagtattagcggtcccctcaatcccccccccaacacatgcacacatgcactgatctgcaggggccagaccccagtggacccggggacacagcttccaggggctgtcttgccatgtcccttcccagacctgcctggattcatgccaggccaccctccacaatttgctgagggaggccccagggtccagggcacccagagtgctaactagcccctgggggtacagggagaacagcatgctgtgtgggggatactactctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggaggggctggccagctcctctccccagcctcctactgtaaaatgggagaggatcccagccctgctgattcatccactcactccatggcaagacagccactgacagctgtgtcctggggcccacccgggcctggcctctgtgcaggctagcactcagcatgcttagtgccacactcggcccaggagaaatgacccagccctgggctcagagaccccacagtgggtggatggaaaacagagtcatttaaatacaactgtgaagggtgctgtggaggaggggctcgaggtccccagtgtgggatggggtggtcatggaacatttccctatctaagtgggaaaagtgagagccaccaggaaaatggcaggggttggggggagaggaactgtgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatcactacaaaataaataaataaataaaataaaataaataaaaataaaaataaaaaaagccgggcatggtggtgcacgcttgtagtcccatctactcagcagactgaggtgggaggatcgcttgagcccaggagatggaggctgcagtgagctatgattgcaccactgcactccagcctgggcaacacagcaagatcctgtttataaaaacaaaacaaaacaaaaaacccagcttgagatggccagggatttccagaggccctaggcgggccaccttggagagtaagggagaccctgaagagctcgcatggaaggaccagcagcttggggctggagatgccacctggatggattcctccagctgtgtggactaggggacagggtgaggagataatggcctggactacatggaaggacgtcgccctgagccattgaaaagggctgtggggtccatgaccactcctggccttcccttgactatgatggagacagtagcttctagtgtaaaatgtgagctcagttcctgactcgtgtctagcgggtggtgcctggtctttggctggcgatgctccatgtcacctatgcccagaaactgggccatgccctttgtgaggacctgcccacaacgtcgttgttcccgcagggtccccggggaaccgggctgcccgggacccagccctgccagggttccctgcggcccaggccggaacccccagggctttggtcgttcccaaagccgtcccgcgggccccctccacggtgcgtcgcctgggccccagcgatggctaggctgcagcctggggctcccggccatcccgggcgctggcggcggtggaggcagcagggcggatggcgacgcccggccgcccgtgggcccaggcgcgtagtgcgtacagagccagcgaggtgctgcggcgcgtcacgggccgccggcgggacccggggccgcaatccaatgggccgggccgggaagacgcccgagccccgggccggctggctcgcctgctccgccagctccgggccgaagcggcttcgcggtccgaggtgccgcggctgctgaagctggtggagcgtgcgggggccggggcggcgggcgcgggcgagaggaccggcgcgcacagccgcggctccgtgtgctcagtatgcggggagccccgcggcagggccacctacccggcgggggtcctggaggtcagcgagcggcggctgcaggagggactcgcggcagtgcgcgaggagctgggcgccgagattgaggcgctgcgcgcggagcttcgagcggagctggacgctctgcgcgcgctgctgccgccgccgccgccgtccccgcctgcccgccgcgagccccgcgccgtcccccgcgccgcgccccgcggcccgaccctgctgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtgtagcgtggctctgagtcagaagggtgcccgggtgccgccagttagggctccggtactggagggagggggtgggcgcgggacgggcggagggtgggccacgtgcgtctggggagtgcggatgggagccggggtccttgcgagagactgagtccggctagagaacagggtggagcccctttggaccttagagctgggcctttgggccttgggtctgggtcagcctttgggccagggctgggtcagcctccaggggaacagccgagactcctcttccttggggtgactgcacgttctttttctttcaaggtctcagtgacgaggcagggtctccacgcactggaatagtgtcaaaccacacacaagggcacagaacccagggacacagggcggctgagacacgcagctggtgatggccctcaggacggtgtcaaccagtatgtaatcacattccacacggcaccaattggacagcggcctccggtcagcctcactctgactgcaaccccctctcactggacagcatcacctggacacagagcctcacctagtctgtgtcccgtggacacaactttgctttggacagtgacaccaagaatactcacccctttacttagccagaccacaggcagccaccgggacacaaacatctctccagagtcaccctccacacagactccacagcagaactcccagggaggcactggggcatggcttcagagcaccaggcagcgctccgcggtgcccagcacccgctcagccagggcagcctgcagcggagcctggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcagtgggggaccgcgccgggtcacgcacccaccccctccaggccacattaggctaaggtcactctgtgcattatttcattatttcacacggagggtcgcccacggttgacagaaccacaagctgagccccaggcgcatcagagcgcagtgcacacctgctagggtgggggaagagcggggggctgctgcggggaccgaggctctgggggaggccaagactgtgtgccccttaagaggctgctgtgggccaggcgcggtggctcacgcctgtaatcccagcactttgggaggccgaggcgggcggatcacgaggtcaggagatcgagaccatcctggctaacacggtgaaaccccgtttctactaaaaatacaaaaaattagccgggcgtgatggcgggcacctgtagtcccagctactcaggaggctgaggcaggagaatggcatgaacccgggaggcggagcttgcagtgagctgattccaccactgcactccagcctgggcgacacagcaagaccccgtctcaaaaaaaaaaagaggctgctgtgggcggaagttacccgtgagcggtatggggtgaaagtgggagggtccagcctggggcacggtgtggaacagggtcatctgagggtgcagggcaaagagatcaaaacggggtgggagaggggcagcgcctgcgggaggagccaggcaaggcccggggaggggtgtggggggcgaggggggacggtggctccacctgcacccaccggatgggtatggggtcctcgaagacggtccagagcaccgtgggctcgcagtcaggcggggtcagtgacccagcgaagcgacagtagctcgaggtgttgggccgcatcgacgccagcaggaaggtggacatcagattcactgagagccccaggcggcagagggagggggattggaaccagcctccccgtgccctgctggtgccatccccagcaaaccccccgcccctgagccggaaaacgacccggtggctcctcacctggctcaggcaccttcctcaagcccgacactatggcgcagaagttggtgttgctacagtcctgctcctgggaggggctccaagtgcaaggggttctgagtgggggagtctctgaagagggaactcagctgggatactctaagcaggaggctcccagtggcaggaggcatctggcatctgggaaatggggtggagggttctcgccgccactggccctgccgattcaggcattcccaccgccctatcctcccacagatcctatagaccctagagatccccccatggactccacaggcctagcctgtccacttccaggatccccatggaccccttttttggaaacatacatagaatcacagccctgccttcaccgccagcagcacctccagcagcagggcctgcactcgagcccatcaccgtggcgtggtgcctcctccatgctctggtactttgtgttactgtggaccacatgcatctgggggtaggcacagatgtgggagatacccagctgcccccaccttgctctctctcatctccgtgggagcactccggccaccccaccttgtgcccaagtctacctccatagcctggcgctgcctgtccaggctgtgctctgagtctgctcgcctcgggccccccccccgcccccagctgatgtgcagccgcagtgcgcggtagacaggcaacagcagcccagcctcccaaatctccaggtggttctgaggatcagtgtccattcagagtagcaatgaaggggaggaggcacacgacaccctctctacctcaccacctgcccaccttgtgccattagagcacagggtacgagcagaggcccttcctcaggccaggctgctccccagtggggccccattgcctccatggaatggaacccatggtgtccatggctcctgctggtcagcagagcagagttccacagactgcaggggaaaccctcccccacacacccagcatggcatggaagaaggcagagggcagccctcctggggtggggctctgagcccagctgtgtgtggtcagggatcctggccctgccagagaccctgactcctggtcctcaggggccatggctggttgtgatttgtagggtgggacctggcacctacacagagggcgcatctggactgctgtgtgaggatgctcctttcctgtgaagctagcccctgtggagggtttttggccctgtaggatgtctcagctcccgtgtgtagggggtcctggtccctgtgtacactcaggagctctcatgccctgtgtggggctcctgctcctgcctaggaggggtcctgaccacagggtgctgacctgtgtggctgtcattctccagggtccaagggcctggaggtgctgagtcatagcctcggaagatgaagggccctagggtagagttccgccggaccctgtgaaagtcaatgtcgatgagggactggcctgggcccccacaggcaggggccagcttcttccagtgggtggggactgctggaacaaggactggggcctttggggtgggggtggggtcagggaggcagcctgggggtgcagcagagagtggcccccatacacccagaggatagcccagcctcaggaaacccagctccctgcttcccccacacctgaacaggtcacagcatcccccttctcttgtaccctgcatctggcctatccatctagtctcccggttggctgccccatggtgagatgaaggcaaaagagtctctggcacacagttgcacacccacactgggacctctatcacctgcacacacttgggctggccacagtaacaggcacaccagccttgactgactcgggaccggcgatcacagcaggcccagactcacacacagggggacagtcacgcacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctcactcagcctcacatgacactctgtcctcaccacacttggggtcctgggagtcgtagcaccaggcacctatagagacagtgggcaggaggctgagctgagagaccagtcatctgggtcctctccaagccccatcccatcagctggggtccaagaatgaagtaggccaggggcttaggccaggggaggccagtgaagaaccttctctcctgtcacccctaccccagtattttctctccccagtccctccccactcccagtggcaagacctaaggggtggtggagcatggcaagagggtagattggagaccagacgggaagagtcctggtgctcactctcagagtctgcgccacaccagctgcactgcaaggcgagcatgatgccaggggcgtgcgtggctcagtggcagccgcagctaggaaggactagaaagtggctagacctcggagccaagatgctggcctggctactacatatttattcattagctagctgggctaggggcgtggctattgaggagaggatgggaggggtcggtgcccaggcagggccaccaggaagagcgcgagcgctccaaactcacccaggtgtgctgtggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgctcatgactttcggggcaaggatgggaggaaggtgtaggatgtctcttgccccactgtgggcctggaactgccaccccatcccaagaccacagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctagaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtcttgaatgcttgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtctgtggtcacacagctcaggtcaggtatttattagtacatgaatagcttagctgtgtcatagtctttatgtgaaaggcacataaaaggcactttggcaggctcaaagtgtggggattataggtgtcagccaccgtgcctagcccactggatgacttatgatatcatatgtgacattgtgacatcatgtgagtcagggatgtaccccgttctcagctgctatatgctatgttacagtgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcgcctgaggcaggagaattgcttgaacccaggaggcagaggttgcagtgagctgagattacaccactgcactccagccttggggacagagtgagactgtatctcaaaaaaataaaataaaataatctaggacaaccaagagaaggactcaggctcaccttactctatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgtgggcctgattcacagtgtatgtgagtcacaaatgtcacttatgacaccatacagcaggtgagaggggatagtcattattcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggaggtgcagacacaaatcacactgtgtgctgtatcccatatatgtgtttaatttctgtgtttaagagagctgggttcatgaatgaacgtagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgttcactgatacatatttgctccgtactgaagtgaggcagatgcatgagtgattgagaataatgctaccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagcatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccaatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccaggcacagtggctcatgtctgtaatcccagcactttcgggggccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaatcggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttgggttttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggctggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccccaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagatgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagagtttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaagtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggcggaggttgcagtgagccgagacagcaccattgcactccagcctgagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaatatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatgtatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaatgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttctgtttttttttttttttttaattatactttaagttctggggtagccgtgcagaaagtgcaggtttatcacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctgattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagtgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcacttcaaataatgtacaaaatctacaaaaatcatatttaccaggacacatctgttaaataaaagcattgtttcgtgttggtatacatatacacaagactatgtataacagactgtttcccctccctgcaaccacagaaccatcacacacaggcacagatacacgtcggctatgccgctttccacgaatgcatggaacccaggacgcgaacccacagctcgaggtcttataccttcactactgagctgccgccactgcagcagcaacacctctgcggaggtgtcgctgaagtcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacagggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacatttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagctgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccgcccctcatggcccggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgcgtgttttctgcacctggtacagctggatggcctcctcaatgccgtcgtcgctgctggagtcggacgcctcgggcgcctgtacggcgctcgtgactcgctttcccctccttgcggtgctggcgttccttttaatcccacttttattctgtactgcttctgaagggcggtgggggttgctggctttgtgctgccctccttctcctgcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttggttctcatgctgtcttttctcattcagaaactgttcgatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttccggcttacatctactgcctccgcctgcagccctggaaggctgtgcatggctgggccccgctggccccgggctgtgcggctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggtgggacagaggccacccatttgcgctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggagagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcgctgcaagctctgcctcccgggttcaagtcattctcctgcctcggcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggttgctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctagaaagtccataatatgtttgacccacttcatggtggtgtcctataaatcccaaaggtttttactttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgccatcaagtgatctgcctgcctcggcctcccaaagtgctgggattacaggcgtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacaaactttcattaatgtctatgaagaagcaaatacctcttcttttcttttttttttttttttgagacagagtcttgctctgtcacccagctggagtgcagtggcgtgatctcagctcactgtaacctccacctcccaggttcaaatgattctcctgcctcagcctcccaagcagctgggatcacaggcatgtgccaccacgcctggccaatttttttgtattttttgtagagacagagtttcaccgtgttgtccaggctggtctcaaactcctggcctcaagtggtctgcccgccttggcctcccaaagtgctgggattacagttgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggcttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggcatgtaaaggcatcactgaattcctgggcaggcacgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttccctttcaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccacataacacatcacaaattaattctcaataggggctgggtgcagtggctcacatctgtaatcacagagtaatttgggaggctgaggcgggtggattgcttgaagccaggagcttgacatcagcctggccaacatggtgaaaccccatctctactaaaaatacaaaaattagctgggcgtggtggtgtgtgcctgtgatcccagcttcttgggaggctgaagcgtgagaattgcttaggagcccaggaggttgaagctgtagtgagcagagattgtaccactgtactccagcctgtacttcatgacaaagaaaatgtaccattgtaccactgacagaatgagaccctgtcccaaaaaaggaaaaaagctcagtagatttaaaatgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaagtcaggagttcaagatcagccaggccaacatggcgaaaccctgtctctactaaaaacacaaaaattagctgggagtggtggtacgtgcctgtagtcccagctacccagcaggctgaggcatgagaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgtctgcctgtctatgttttagagacaaggtctagctccattgccctggcaacaatcagatgcaaccacaatcagtggcacaatcggctcactgcagccttgaattcctgggctcgccactatgccagctctttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtctcatgcctgtaatcccaacactttgggagcctgaggtagaagttgaggtcaggaggtccaagacaagcctgggcaacatagtgagtctacaaaaaaaatattgagaatctacataaatatagtgggggtgggggtggggaacaagaaaacaaaaaattcaaagcatagtgaaaagaaatatagcaaaacccagccgggcatggtgcctcacgcctgtaatctcagcactttgagaggccgaggcatgtggatcacggggtcaggagatcgagaccatcctggctaacacagtgaaacctgtctctactaaaaatacagaaaaattagccacatgtggtggcgggtgcctgcagtcccagctacttgggaggctgaggcaggagaatggcgtgaacctgggaggcggagcttgcagtgagccgatatcgcgccactgcactccagcctgggcgatagagcgagactccgtctcacaaaaaaaaaaaaaaaagaaagaaagaaatatagcaaaacacaacaaaaaaattaaaatttgctgggtgtagttgtgcctttagtctcagctactggggagggtctgctggaggatcacttgagcccaggggttcaaggctgtgattaagccactgcactccagcctgggtaacagagcaagatcgtatctctaaaaaaaaaaaagaaaaaagaaaacactctctggccacagatgagagaaggcagacaggaagccagtaagccaagcaggcagagggcaggtggccccagcccagctgtcgggtggtgagcagtgtcagggagacaggagtgccggagctggtgaggttcccaaggaggtgaggttgcctgtggccccctcccagggcacagtcccacccctccagtagtgcactctgtcctccctggtaggtacaggcttttccccaccaccatggtgcagccatgcctgcccccaacaccactggtgcagctccatcctccacgcagtggtgcagccccatcccagcgcccattcgagctgctgtcccattgcagggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaaggtgagtggtcgcaccacagccgtgtggtaggacccatgacactgcctctctctccccacgccccacccctcctgcatctctgctcgccccccatgccacgtctttccatcactgagctcctgaggtgtgtccctgcgtcacagctcaccatgtcctgaaggaggcagtgcagagcaacagggctgaagcgggcaatgctcaagggttggaggaggaacaggagtcatcaggagggagagaggtgcaggagctcagggctgcagggccggtccagagggtaccccggtccagtgggtgaccctgccacttggtcattgaatggccagagctgatgcgtgacgtgaggtccaggctcaggagccctcaccttacttcactctcaccacagccttctgaagcagctgctgctattggttattaaacgctccttgaggtgggcaaagtggctcaggcaggtgttaaccctctgagcccctcagagcctctggggctcagcaacatgcacctggctctgatcaaccagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtaaggggcaggggctggctcactgtgggtgtggggcctgccgtagaggcatcaggtgggctccccagggtggctacagcctcacatatgctttatgaatccattcctgccacagaatttgattgcgggcctactgtgtgctcggatggactcgtgggtgacccccagtcttggcttctgccccacagaactgacagtgtggggaattagtggccaccctcctacctcaggtcctttgcacatgctgtggttcttgagtgctcagtgctgagatgaggaatgcatgggggcattgcagccctcgggcatggtgagatggatgggtgaaagggagagggccaggtgaacagagacctcggccacccactccctgtcactccaaactaacgcttcccagatgccaccctcagccctgcaccacctgacccactcacccagtagttgccccagctccatgctgggtccctataagaccctgtcatatcccttcccgctgaggatcctcacatccctccttacctacttgggtccttggcattcctgggcggatctgcagacccccccacactgaccagtgacctcccaggaggggcgtcagctgcccgggtggtgtcttctctttccctgtgagcattctgcacctctgactcccgctgcagccagtgacctggtgtcttgtctctctaaggggacagagccactgcagcgtgtccctctgccctcctttttggctaaggccaggtccttcatctactcgctggctcggggtgctgttcctacaatgctcctgtctgcctctgatgatttatttctttatcacggattattcccaaaaaaaaggcagctgttattgctctagagacttctatctgctgcctccttctgtcctttgctcctcttagagcaaacatggctgggctatgtcctctctcccttcagggtatcccctcccctgctctatccccatgccaccagatcgccatgtccagcctcagtttccccatcaggccccactcagcagcatctcacacagctcaccacactctcctcgagttttcattttgcaaattttcgcacctacaaaaatgtaaaaaaaacccaaaactgcccaagcatcaatgttcccttttcctggattctgcagtgtggacatttctgccggatttcctaactctctccgtctccacccacatctattgggattcgtgtttttctgagggattccacagtaggttactgatgtcgcacctcagggtgtgtctcaaaagtgagacttgaacatagcacagcaggatgtcggggtgacacaacctgctgtcccttctctttacctacagtaggctcccttggctgttttgtttttgttgtgtttttgtttgtacacagagtctctgtcatccaggttggagtgcagtggtgtgatcttggctcactgcagcctcaacctccagggctcaagcaatcctcccacttcagccccctgagcagctgggaccagaggcacgtgccaccaaacctggataatttttgtattttttttagagacagggtcttgcccagactggtctcaaactcctgggatcaaactgtcttcccacctcagcctcccaaagcgctgggattacaggtgtgttttttctttgagacggagtctcgctctgttgcccaggctggagtgcagtggcgctatctcggctcactgcaagctccgcctcctgggttcacgccattctcctgcctcagcctcccgagtagctgggactacaggcgcccgacactgcgcccagctaattttttgtatttttagtagagacggggtttcaccgtgatcgcgatctcctgacctcgtgatccgcctgcctcggcctcccaaagtgctgggattacaggcatgagccaccgtgcctggcctgttttgttgatttttaaagcccagggcagtagtcttggaaaatgtcccacatcgtggatttgcctttctgtttccttgagggcagattcagacagaacacctttccctgggattggtcagctaatccgtggggtgttgctgaaactttattttattttattttattttattttattttatttttgagacggagtctcgctctgtcccccaggctgtcccccaggctggagtgcagtggcgggatctcggctcactgcaagctccgcctcccaggttcacgccattctcctgcctcagccccccaagtagctgggactacaggtgcccaccaccgcgcccagctaattttttgtatttttagtagagacggggtttcactgtgttagccaggatggtctcgatctcctgacgtcatgatccgccctcccaaagtgctgggattacaggcctcggcctcccaaagtgctgggattacaagcgtgagccaccgcgcccggtgttgaaactctcttgaggcattttcttcggccttcgggtccatcctctctgtctcctctttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctctttgggtctgatgaagtatccaaaatcaagctcctgaccatccccaaaccggccccttctgccggcctcgctagtcggcaccatgcttgattcttctctttctcccacccaggccatcatctcttgcctggttgatacccacagcctcccctttgggctttatccttatccccgtcatagctgccagagggaccctgtgaaaacactccccagcctcctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcctgtggtttcagcactttccctgtgtgtgtttgtttttcttggcatgagggcaggacttaagtgtctgttccctgttgattccccagtgccaggcatgcagtgcaaattctagaaatattttttgcatgaaagaatgagtgattgaatgcggcaagggtctggaggctgaggaccaggcagacagacattcagagttgctggaacgcgacagagacagggagtcagactggtcatgcaaggtcctgggcctgcccttgggtcctggggagccacggaaggttgtgggtgccagagggttgcggtcagagtcacagtcaagggccttctgagacctgtgccccctccccacctcctcaggccagctctggggtctcagcaggtggtccgcaacatgacctctgagttcttcgctgcccagctccggtcccagatctctgaccacaccactcacccgatctcctacgacaagcccgagttctacacgccggatgacgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcgggtgctgtctgacctggctgggcggtagctttggctccaaggtctgctccccggtcagtgggatcctgttcaataatgaatggacgacttcagctctcccagcatcaccaatgagtttggggcacccccctcacctgccaatttcatccagccaggtatggggtggaggtccggggggtgggggactggggtggagaggggcgggtgtcctgggcaggcagctgacgggcatccctgtcttctcccatcggccgcagggaagcagccgctcttgtccatgtgcccgacgatcatggtgggccaggacggccaggtccggatggtggtgggagctgctgggggcacgcagatcaccacagacactgcactggtatgtgtcaccccttttctccctggccctgcccactctgcacagcccccaagccacgctgatcacactcccatgccccaggccatcatctacaacctctggttcggctatgacgtgaagagggccgtggaggagccccggctgcacaacaagcttctgcccaacgtcacgacagtggagagaaacattgaccaggtgggccgggggttggagaaactgagtcacggtgtggggtcccagggcatcctgggctggaggcctggatcatcacagagtggacaatggttggtgtcctctctctagtgcctgggccatctggagcccctgtgacatgagggccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgagtgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccactctctgggcctcagtgttttgtgtgtgaaatggagccatctggctggggaggaacagagaggtgggattcggagatcttcacaatgcggacactggaactagcctcagcatcttcagcatggggagagccaggcacatggctgggggccaggggaaggttcacaccaaaccctgccccttcccaccctgatccctcagactttggggccaggccctcccttactggggctgggcagtgacactacctaggatcagccaccagggggtgtcacgaccctggcgctttcttaggcagagggtggccagccgatgctgggaacccgggcgccttctcagacccgtaggcgtccagctcaccctgccgatgacactggaggtgaagctgagggtccgaggaatggggactgggcaacaggctggaggaaaacatctcggtcagagccatgcccctggggggttcccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccggaaggaaacagctcgacacagcagccttcaccatcggcagcccctccaggcctccctcggggcctgctccctcctctgtgcacagttccaacacctggagcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacagggttttatgcctgtggagtcaagtcccactgggtctgagctctggagggctgtgtctctggggctctgcaagggtgagatggaggtgggctcaactggtgtacaagtcactcttcaatccttattttatttatttaatttttttaaaaaaaatttaaaccaatagagatggggtctcactatgttgaccaggctggtcttaactcctgacttcaagcagtccccccatctcagtctcccaaagtgctaggattacaggggtagccactgcacccggcctcaatccttatattggcctgagaggaaaggccgtggccccatttgcaggggagaagactgaagctggaggggcaggccttgctctgggttgcacagcaggaagagaagtgggagctggccacgaggcttcctggacccgaaatgctggtggggtacaccctggttctctaggtcccatggggctcagcccaggactacctcggggggtgagggacttaaatcgtctccttcattctcatcgccccttcccccatcatttcctgaggaaggacattcagggacctgaaggggtggcctgcccctccccacctgtgggtgtttctcatcagctgggacaagagactgagaaaagaaagagacacagagacaaagtatagagaaagaaaagtgggcccaggggacctgcactcagcatacggaggccccacgctggcaccagtctctgagttccctagtatttattgatcattatctctaccatctcagagagggggatgtggcaggacaatagggtaatagtggggagagggtcagcaggaaaacacgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagcagatggaatatacaatcaacactgagacattcctttgcccagggacgatcaggagagagatgccttcctcttatctcaactgcaaagaggccttcctcttttactaatcctcctcagcacagaccctttacaggtgtcgggctgggggacggtcaggtctttcccttcccacgaggccatatttcagactgtcacctggggagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctcgggcggtccctgcaccctggcctctgcctgacgaggatggtggggagaggagggggacgtcccccacactgctgtctccactgttcctgctgcccaggcctctgggcttccaggactgcagcgggtcggtgggtgggctggcctgagcccaggaatgcacttcagctcctggttgagcaatgtcactgaggcttgggagtcgggtgggggcgggaggaggcgtccgcaggcccccctaccgtgagaggcagccgtgggaacagcctacctctaaacaatcactgcagcccaggctggccaggggctctggccggacataggggcctggcaggctgtgtgccctgtaaggacacagtctgtctctgtgcctcagtttctctgctgcccagatggaggggcccagactccaggtgtagacatctggagcaggcagtgttcagttggggaggaagcggggaggactgtgggggccatgtgggaaggattccaccccacatcacctgcacccctgctgagcctggtcaacggagcccctcagtgggtcctcactcccctggttgcctcccatttaggcaccctgaggcctggggagaacagagccaggccagtgtccccagagaggctgcgctgccagcacagtagtagcggatttggattcagggaagcagacctgcagccagggtgggaaagagctgcaggtggggtggggcccccacatggcacagcccccctccctggaggaccatgctgcatttccaggacagcaagtcccagggatggatggtgcctggtgccaagggctagaggcatggtctgtctgcatttcccacgtaagtgtctcgtagtcactagcatttgatgctgtcaagaccccctgtcctctgtgcagactgggaagcccttggtcaccctgggggagttgggggacccaggccaggctgcagaagcataaggacttgaacccgggtcctgagtgacaccaccttgggtcctcctccttctgcctctgttcagctccaccttgatgctgactaggctgggccatgcggagagggttaggggatagagatgggagctggggagcagggctccactctgggaggggggcagccttgccggatccagggcagagttaagcggccccagctctgctttcccagagctgctgagaacctggggaatggtgtggaggttccagggagccctgcccctacctggcaaccgcagtgcagcacgcaccaagttctcctgcacattgcgacagtgtgaccatgggctctggtgggcggtaggtcgggcctttggacctaccagcagtgagggagttaacacagcagctgacttctctaggcaaagaaaactcccctcagacgctttgctgcctggcctcctgccaggaacaagcaggagctgaaaactagaagttgaggcatgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccatctgcccaccggcctcccctctccttctgggccgcagagccatggcccaggactacggagccatgggtgacctggtcctgctggggctggggctggggctggcgctggctgtcattgtgctggctgtggtcctctctcgacaccaggccccatttgacccccggcctttgcccacaccgctgttgctgctgactccaaggtcttctcaaatattgtacggtgagtgagacgtgggaggaagctgggtggcctttggcagccagcccctcctggagaaggcgtgtgtgtgtgagcatgtgtgtgtgtgagagattatgtgtgagtgtgtgtgggtatatgtgtgagtgtgtttgtggggtgtgggtgtgtgtgaatgtgtgtgatcgtgtttgggtgtgtgtatgtgtgagtgtgggtgtgtgtgaatgtgtgtgattgtgtttgtgtatgtgtgtgtgggtgtgtgtgagtatatgtgagtgtgagtgtgtgggggtgtgggtgggtgtgaatgtgtgtgattgtgtttcgctgtgtgagggtgtgtgtgactgtgagtgtgtgagtgtgggtgtgtgggtgtgtgtaaatgtgtgagtgtgagtatggggggtgggtatgtgtgaatgtgtgtgattgtgtgtgggtatatttgtgggtgtgtgtgtgtgtgcacgtgtgtgtgtgtgcacgtgcactggcccaggaagcaggagccgtgtgtgtgggcttcagcacctgcagggcttgagcgcaaggagacagcctcagggcccttgcacagaacaggcggcagggtgtgcccgtggggcagatggggacttggggacaatggtggtgtgtgagtccatacctggctccaggattcaggaggcccatttgcatatcccaggtgggaacctgtctggccccgcctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacacacaggatgccccttcttgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgttcattcattcaccttttcattcattccttcttccctccattcccccatctgtccatccttccctgccctgattgctcatgccacccccccagcccctcctgacctggtcctttggtttctcttcagggctttctgtctcctcccacagggctgagaatggcagctcagggacaagtgggggctggggactgcttagtctccccagtggctctcaggggatttgagggtttgacgtcagctgccaccccaggctgtgcccctcctctgctcgggaggacatacagagatgcgacacccacttaaactcgaagttgcaaagatgcaaatgagactggggtctcaggcaccagagaccacccgtgggcacgtggcttttgggagtggggacctgctgccacagatctctgaagagtctggacctgctgggtctccccgagtgactgtctgggggtctccatagcatgccctgctgtgtgcgtgacggtcactggttgggtaggggtctctactctaaagctccctctgccggcatcccctcgaactctcccttggtgaagagaggatgtggtttgccccagtgttttatcaaacaactctctccacttccagttttaagaagctgggagtggaagagagcctggggctggccccagctgctgctgtgaaacaggggtcactggacgctgggaccctggccgggctggctggaggcctcaggaagaggcctgctacagcgtcatcctggccaagattcctccctgcagaggaccctggccacgctgccacagggtctgctggggccaccagaagcccatgctcctgcctccatctctcccctctgtgctcacctctcaccaggaggccctcccagagttcagtgtcctgcttttttttttttttttttttttttttgtgacggtgtctcactctgtcaccaggctggagtgcagtggcgcgatctcagcttactgcaacctctgcttcctcggttcaaatgattctcctgcctcagcctcctgagtagctgggactacaggtgccagccaccacgccccgctaatttctgtatttttagtagagacagggtttcaccatgttggcccaggatggtctctatctcttgattcacccgccttggccacccaaagtgctggcattacaggagtgagtcatggcacccggcctcatctcctactctttcagcaccaggttttattcttgggattctgctacagccggagcccctgggtgcgagttcctaaggtttctgtgagtgtggacccagcaccgtgcctagtagacatacaaaaggagcatggtgacagtgaggtctgtcatctccagcataatgactgttttgatccttgtaaaaaaggtgatttttggctgggtgtggtggctcacacctgtaatcccagcactttgggaggccgaggggggtggctcacttgaggtcaggagttggagaccagcctgggcaacatggtgaaaccatgtctctactaaaaatacaaaaattagctgggcatggtagcaggtgcctgtaatcccagatacttgggaggctgagacaggagaatcacttgaacgcaggaggcaaaggttgcagtaagccaagattgcaccactgcactccagcctgggtgacagagcaagacttggtctcaaaaaaaaaaaaaaaaaagaaagaaaagtttatatttttgttctaatgcttatcttaatatcgtcattctataattatatgttttatataattataatagctatataagatataatacccctagtatgttgttttttggatattctacttgctcctgatggttaatttatgtgtcaacttggctaagctatggtgtcctgttgtttggtcaaatacttgtcaatatcttgctgggaggttatttcatagatgtgattaacactgacagtcaattgactttaagtaaaacagattacccaccataatatgggtgggccacctccaatcagttgaaggccttaagaacaaaaactgaggtttcccagagaagcaggaattctgcttcaagactgtaacacacaaaccctacctgagtttctggcctgctgactgctctacagattttaggttccagacttcgagatcaactcttacctgaatttatagcctgctggcttgccctacagattttaaaacttgctagtccccacaatcatgtgagccaattcctaaataagtctctctctatgtataatctattggtttagtttctctgaaaaactttcacattccagtttcctggatgttaagaattaccgaaactagctagtaacttctttttttttttttttttgagacagagttttgctcttgttgcccaggctggaatgcaatggcacaatctcagctcaccgcaacctccacttcctgggtccaagcaattctcctccctcagcctcctgagtagctgggattacaggcatgtgccaccatgcttggctaatttttgtatttttagtagagacagggcttctccatgttggtcaggctggtcttgaactcccaacctcaggtgatccgccgccttggcctcacaaagtgctggaattacaggcacgagccattgcgcctggctcctagtaaattcttcttttctgtgatgtgtcccttacctctaataatacttttcttcttaaagtctacttcattaaaaatagttatgctgggcatggtggctcatggctgtaatcttggcactttgctggaggtcgaggtgggtggatcactgaagcccaggagttcaagaccaacctgggcaacatggcgagaccctgcctctacaaaaaatacaaaaattagctgggtgtggctagtataattctaagttggcacacttgtagtcccagctacttgggatgctgaggtgggagaatcgcttgagcctagaagggagagattgctgtaagccaagatcacatcactgcactccagcctgggagacagagtgaggctctatctccaaaaaaaaaaaaaaaaaaaaaaaaaaaaagttatacagctttcttggttagtacatgcatgacatatttttcatgatcttccacctctctgtacccttatataaaaggcattagttgggttttactttattttcaattattttaatttttattgtccttttaaatgtaactaatgatttatttgggttgaaacccaccaccaatttgttttccatgcctattctatttcttcttatctcctctcacatcttgttttggatttattatttttattatttaatttcctccttctctattagtttcataactgtgcagtcttagagttcttttaaaagatgactggattattttagagcttacaacatgcatccttcccttatcaaagtctaacatgagctagtactttttgttgtggttgagatagagagagtcttcctctgctgcccaggctggagtgcagtggagcaatcttggttcactgcaacctccacttcttgggttcaagcaattctcctgcctcagtcacctgagtagctgggaccacaggtgtgcaccactatgcccggccaatttttgtattctttttcagtagagacagggtttcaccatgttggccaggctggtcttgaactccggaccttaagagatctgcctacctcggcatcctaaagtgttgggattacaggcgtgagccaccgcacccagcctatgagttagtacttctatcctcttcctagtcagtacaagaaccttggaacaggaactaaatttacccccagtgacttatatgctaatatttttgtgtattttaaatatgtgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttccgtgcaaatcccagatatataactgtacccatacatatttcagtatgttttatttcttttaaaccccacaagatatcattttctatactactgtaattttataccaataacattcatttagatttacccacacgtttaccctaccctccgggtcctgtttgaaaatcaagcccatgctcacaggccaatttttttttcttttagagacagggtctcactttgtcacccaagctggagtgcagtggtgcgattatagctcaatgcagcctccaattcctggactcaagggaccctcctgcctcagcctgccaagtagcttggactatagctgtatgttttattattattttgtagacatggggtctggctatgttgtccaggctattctcaaaattcccggcctcgagcaatcctcctgcctcggcctctcaaaggttgggattacaggtgtgaggcaaggcacccagctcagccacagagccctgttgcatctctcttactaggagcaagagctgactgccccctcatccccattccagagtgttggggctgtgttgagccgaggccaggccactggcatggcccaaggaacgggatcattcactgctgccccaaatctgacatcattccaccttgacaagacttcctcatccaatccctttacttgacagctggggaaaccaacgcgcacagagcacccccagctcactcggggtctcagagctgatccatgagcagaggctgagatcctgggatcttgtcccccagccgccctgcaagcttactccctttctgctggaagagatggggccggacctcaaccagcagccctggcctggacatgactgtgctcacccaggtattgaggccgagatgccccggcatcatatgtttttctcttattttttctttttttttgagacagtatctcactctgtcacccaagctggagtgcagtggcatgatattggctcactgcaacctctgcctcccgcttaaagtgattctcctgcctcagtcttccaagtagctgggcctacaggcttgtaccaccacgcctgactaatttttgtatttttactagagacagggtttccccatgttggccaggctcgtgtcgaactcctgacctcaggtgatccacctgccttggcctcccaaagtgctaggattacaggcatgagccatggcatcacttaaacgtagtgagaggccgggcaaggggctcatgcctgtaatcccagtgctttgagaggacgaggctgtcagatcacctaaggtcaggagttcgagaccagcctggccaacatggtgaaactgtgtctctacaaaaaaatagaaaaaaaaaatccctgcgtggtggcaagtatctgtagtcccagttactcaggagtctgaggcatgagaattgcttaaacctcggaggcggaggctgcagtgagctgagatggcgccactgcactccagcctgggtgacagagcaagactttgtctctaaataattaaataaataaatatggccgagcatggtgccttaggcctgtaatcccaacattttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcgcttgaacctggaaggcagaggttgcaatgagccgagattgcaccgctgcactctagcctgggcgatggagcaagactccatctcaactaaataaattaataaatacagagcaagattccatctcaaataaataaataaatgtacacctgtaatcctagcactttgggaggctaagacaggtcgatcacctgacgtcaggagttcgagaccagcctgaccaatatggcaaaactccatctctactaaaaatacaaaaattagctgggcgttttgacgtgtgcctgtagtcccagctacttgggaggctgagacaagagaattgcttgaacccaagaggtggaggttgcagtgagccgagatctcggctgcacttcagcctgggtgacagagtgagactctgtctcaaaaggaataaataaaatacaaagtaaaaaaaaatgtagtaagattgcagagtcgtgccgcagaagcgtgctggtcctatccatgtagtgaaggctgatttcatacacaaatgtcacaagaacttttcttttctttttctttttttttttttttgagacggagtctcactctgtcacccaggctggagtgcagtggtgcgatctaggctcactgcaagctctgcctcccgggtttatgccattctcctgcctcagcctcctgagtagctgggactacaggcgcctgccacctagcccagctaatttttttgtacttttagaggagatggggtttcaccgcgttagccaggatagtctcaatctcctgacctcgtgatccgcccgtctcggcctcccaaagtgctgggattacaggcatgagccaccacacccggccttcttatatgcttttattgcatttgagcgtacctcttttacagcgaagatctttttttttaattttattttatttttagagatggagtcttgctttgttgcccaggctggagcactgtggtgtgatcatagctcactgcagccttgaactcccgggcacaggtgatcctcccacctcagcctcctgaatagctgggactacaggcatgcaccaccatgcctggcatattttaaagatgtttgtagacatgaggtctcgctatgttgccaggcttgtctcaaactactgggctcaagccatccatccatttcagcctcccaaagtgcttggattataggcatgagcactgcgcctggccatcacactgtttttttggttgtttgtttgtttgtttgttttgagatggagtcttgctctgtcgctcaggctggagtgcagtagtgggatctcacctcattgcaagctccgccttgtgggttcacgccattctcctgcctcagcctcctgagtagctgggattacaggcgcccgccaccacgcctggctaattttttgtatttttagtagagacgggatttcaccgtgttagccaggatggtctcgatctcctgacctcgtgatctgcccgcctcggcctctcaaagtgctgggattacaggcatgagccaataaatatttttataatcattaactaccgaggagaagctggagagaaaaaaggtggatgaagttaaggcagagagactttgtaagtttcttggctgagcttttggagactgtatatcagagatcctatttgaggtgattttcagctacagagataggcctggtcatttgaaaaataacggattaggtgaagcttgcgtttgaaatcctccttctacttttcatctttctctcttgtttattctgagcatccatcttagacacccaatctttgtcactttgtggttgtcattgatttccctgttattgagattagaggttggcagactttctctgtaaagggctggagagaaagtacttcagactttgtggtctgtgcggtgtctgttgcaaccacttaactctgccctgtagagcaaaagcagccgcagacagtacatgggcagatgagcatggctggggtccagttacatttacttgcaaaaagagggttggagactgggtgcgatctcccacctttaatcccggcactttgggaggccgaggcaggaggatcacttcaagccaggagttcaagaccagcctgggcaacaaagcaagactccatctctacaaaaaaataaaaattattatagctaggcatggtggtacacacccgtagtcctagctactcaggaagctaaaactgaggcaggagggtcagttgagcccaggagcacgaggctgtggtgagctattattgtgccagtgcactccagcctggtgacagagcaagaacggtctcgtcaaaaaataaacaaaaggctgggcacggtggctcccgcctgtaatccctgcactttgggagactgaggtgggcagatcatgaggtcaggagattgagaccatcctggctaacacggtgaaaccctgtctctactaaaaatacaaaaagttagccgggcgtggtggcgggcgcctgtagtcccagccactcgggaggctgaggagggagaatcgtttgaacctgggaggcggaggttgcagtgagccaagattgtgccactgcactctagcctgggctacagggcaagactccattaaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaacgaatagaaacatagtgcttaacttcccaggccacctattttgttcctctccaaggtgatggatagatgaaggccttatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcggggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggcttgtgctatagaaattcaaaggcaagggaagtcacttctgttgtggggccctgggaggagcctccaggctggaaaggcttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggagcccttgaaggggcaaggaggcgaggagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctgggcgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttttgtcttggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatacttcgaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattccatcaaaacaccgctacatagaaaatccccatgcacatatttctcctaattgtggaaatattttacataaaagactctagacatgggatgaaattcccaggttattggaattttaaaatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcataggaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgctatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataaataaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctcaccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagtccactgggctccggctgtttccatcacatggagaatgactcagagcctggcctccagccaccctcctggcctttctgcttctcactctgccactggctcctcatggaccaccagcctgggtgtcctcagacataccacacacttcactgtgggagtcacgcagccctcactgctccttcgccagggagccacggggctttcctcctcaggaggactctgcaagcagctggatgaagggccctcccgtctctcatccttccttaatttttgtcacagttctccttccttccactcagtgcagcgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcacaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacctccgaatgcaccactcttccattatatccagtcaattgctggttaccttgggcctacaactgggggagggcaggggctgctggccacctcctcatctacagtaagagtcaatgagcagttaagtggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccaatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttgaaggaagtgcctgtgagagagttgtgtccctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaatatcacagcaccctcatagcccagagagacagttctaactattatgccaataaacccggaaaagaccaaatccaatatgacacatatttcctgtttccttttgatttcatgccccctcccttaacctcccaagcagcatggataccccgaaggcccctgggaactctctccaattggatcttacgtggaaagtagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacattgttttatacttgcaaaatcatttgctctcaccagactccaaatcctccttcccaaaaggagcccagaatcaggtttctgtaccctagagatggcgttttttcctcaggaagtgagttatttcagggtaggtatcattctccagtgtcaatggctcctgcaattatagaaaagaaaacattaggagggtgaaatgatgccatacacgtcacacagatctgatagtctctcgacaacttgagagagaaaataagaaggggtatagtgattgagtcaaaggtcaaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatccataatgcacactggcagatgttcatgtctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattcgctatgtcttgtaaagcatcctcattagcgatgtcatatacaacgtcctcattagcgatgtcgtatacagcgtcctcgttagtgatgtcttgtacggtgtccttataagcaatgtcgtctacagcgtcctcgttagcatgccttgtgggtgtcattagcgatgtcatatacagcatcctcattggtgatgtcttatatggtgtcattagcgatgttgtgtacagcgtcctcgttagcaatgccttgtacagtgtcctcgttagcaatgtcatatacagtgtcctcattagcgatggcttatacactgtcctcattagcgatgttgtgtacagcatccttgttagtgtgcctcgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttttttatatatactttaagttttagggtacatgtgcacattgtgcaggttagttacatatgtatacatgtgccacgctggtgcgctgcacccactaactcatcatctagcattaggtatatctcccgatgctatccctcccccccccaccccacaagagtccccagagtgtgatattccccttcctgtgtccatgtgatctcattgttcaattcccacctatgagtgagaatatgcggtgtttggttttttgttcttgcgatagttactagcgatgtcttatacggtgtcctcattagcaatgtcgtgtacagcgtccacgttagcgtgccttgtcggtatcattagcaatgtcgtataaagcgccctcattggtgatgtcttgtacggtgccgtcattagcgatgttgtgtacagtgtccttgttagtgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcgatgtcgtgtacagcgtccacgatagcgtgccttgtcggtatcattagcaatgtcgtataaagcgccctcattggtgatgtcttgtacggtgccatcattagcgatgttgtgtacagtgtccttgttagcgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcaatgtcgtgtacagtgtccacgttagcgtgccttgtcggtgccattagcaatgtcgtataaagcgccctcattggtgatgtcttgtatggtgccgtcattagcgatgttgtgtacagtgtccttgttagcgacggcttgtagagtgtccttgttagcgatgtcatatacaacgtcctcattaccaatgccttgtatggtgtcctcattagcgatgtcgtgtacagcgtcctcgttagtgtgccttgtacggtgtcattagcgatgtcatatatggcatcctcattagcgatgtcgtatacggagtcctcattagcgatgccgtgcacggcatcctcgttagcaatgccgtgggcagcatcctcgttggcgatgccgtgggcggcgtcctccttggcgatgccctgggcggcgtcctcgttggcgatgccctgggcggcgacctcgttggcgatgccctgggcggcgtcctcgctggcgattccgtgggcggcgtcctcgttggcgatgccctgggcggcgtcctcgttggcgatgcccttgtcggcggcctcgttagcgatgccgtggacagcgtcctcgttagtgatatcgtgtgaggcatcctcgttagtgatgttgtgtacggtgtcctcatggggagctagaagaacacagagttaaggtcagtgccctggtagtggagactgtgaatcacccaggggcttgcttggtgtggtgcatggaggtggctgatcacagcatgggccaagctgatgctgggacatcctcccaggtggacctgcactagtgaagctaagggatgtggctcagaacactttctgcagtgggcatcagtttccaggttcaggtatgcattatccagtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgcgaaatctaacttagctgccaacataaagattctatctcatttacttggtctcgagaaaatctagcacatagtaagtagaccaaaatgttcattaaatgaaaacacagagcagagataggggggctgctaggcagactgggttgcacctgattacctggatgataattaactgcacaaaacctcggtcaaattaatattgaaactgccttttgcttgggctcgtttcccttgcggaagaaggatgaccaaggagatgaacaggaaagaaatgagaaacagaggcctttgcctagtagctaaaggccaccttctataacacgaaatagccttgaactctgccgtgatttagtgacagagttccctcgtgtcttctacccaggttgaagtccagcaaaattgcgactgtcctctttacaacttgcgagaccacactgcttctgcatttgcctgttgtatgtatgagatttacacttgttttaaagcaacattttgtttcagttgggctggtggccatacccggcactagccagtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaacaaactctcatgacacacatttatatatgtagcaaacctgcacatcctgcacatgtacccctgaactgaaaagttaaataaaaaaaaaaaaaggatcggtgagctgagccaaacacctggggatctttgtgcttttgacacactgatgactatgcctgtccgtggggagatgaacccataactgccctgggttgtgtgaccacggaggccactttatgatgatgggcagtgtctggggccttttgggctcggtgccttagggtttatacatgaatgctggactccctgtgtggtggtgaacaccccatgactaagtgcatgtcagcgtcagcactggcccacactcctgggttcgtgttttcactttttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataaatgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggtggctcttcacattgaaaccaggcaaggatgccacacctttcttggcatccagattgttttcttggtaagtgattccagaatacttactagattcacgcctcagaggggccacctgcaccacctgcaatacagaaacaaagctttttgaggggtatgtcatgttgtggattgtttgcacaaggctgtgtttctctcaatgaatattgaaaacttgatcagaaagtgtagtcaacttcaaggcctccaaaacaagggtaggatacacactggaaaagacatcagcttctggatggcggatctctcaggtccacgtaggttggcaagtgcaaaatactgaatccaaggagaagacattgcttccaaggacaaggaccccaaggatacagtctacaacctgaagccatcatagctaaatgccattttggattacatatcagttgctaagagtcacttcttcctccccctcagaaaactgcatttaatacctgtcatggacattgtcatcttttcacatgtaaagtcagttgaaaaagaaagacaacaagaaaggaacatttctatttcagagaaagcaaggcaaccttaccttcacgttgactggcctctctccatctcctctgtccttgtgaactagagactcctcagaggctaggaggacacagagcaacagttagtcatagatgcttttgttcatgagctattcagggagctctgcttaatgtggacaacaggacagtgtgtgtggatgtgtttcattaaaagcacagcttgagctcctgctagaaaatcctccctcgtggaaagacaggcaagaacgaggagctaaggagcaagaaatagagtccctggcattttgctgatggcaacttaaggcaatgggaatgagtcagtctacaaatggtactgaagcacatgctatagtttgatgagagtcccactgctcacactgtgaggtttgaaacccagctaaatggttttctaaacctgtaaaaacaatattacttgcaggatttatgtcccaagactacttttacctctgaggatccacagtggctgtcactgcagttattatgtgttttagcattttgcacttgaataaaagcaaagtttaatagacagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagacaggagacatgggttgaatgctggtatgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaatgaagtttgtgaatctaaagttctacacaaagggggaaatatttgcaaatcatttatcttgtaagagactaaaatttagaatatttttaaatatatttaagatatattcaaaaatctacagcaacaaactaactaaataaaaatcagacaactctttaaaaatgggcaaaagacttcaacatatatttccctaaagaagatatagccacaaatagtagcacaggaaaagctgctcaggatcattagtcattagggaaatgcaaatgaaaaacacaagcagccaccaatatacacctactaggatgatttaaaggaaaataagtgtgaacaaggatgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtcggataggaatcaccatgggctggaaatagggggaaggcgctatattgcttattgtggacaaggttttgtaagaaatcatcaaaattgtgggtgtagatagtggtgttggttatgcaaccctgtgaatatattgaatgccacggagtgcacactttggttaaaaggttcaaatgataaataatgtgttatatatatttccccacgatagaaaacatgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgcattgctgacccatctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggcatgaatctaccccaaatgtccctttctggaggaagccaccattatgctgtacctccaagcataatgatacgtccacacacaccaaggcacctcactcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcattgttagtacaagtgtttttcccccttcaaatttatgtctttgttactgataaatgtaactgataatgcttttttcagctatgttgccaagcatatttatataaaaatatactcagattgttttcagaatttgacaaagatgatagcaacaacgataatctcatttgtcttatactaatctttatgtgttactttcatcatttcttacatattggggcctaccatacattgtacggtgaaattagtgctatgcatcatggtaggaatataaattggcaaaagtaatttagaaaatagttcccttctttcttaaaaaaattaggctgggtgtggtggctcatgcctataatcccagcactttgggaggcagaggtgggtggatcacctgaggctaggagtttgagactagcctgaccaacacagcaaaatcctgtctctactgaaaatacaaaaattatccaggtgtggtggtgtgtgccagttgtcccagctactcgggaggttgaggcacgagaattgcttaaacctgggagatggaggttccagtgagccgagattgtgccactgcactccagcctgggtctcagaaaaaaaaaaattttttttgaccaaaatgtcattatgcattacatgactgtatatgaatgctcaaagctacattactcatcaaagaaaataacaaaacaattaaatgtccattaactgataaatgaataaacactatctgtatgaataaacacagcagactatgaaggaaaacacatgaccagcacgtgctaacacgtcaattaacttcaaacatagtatgctaaatgagggaagtcagattccaaatatatatatatgtccatttctataaagcaagtgggaaatttatggagatggaatgtcacagcagtattgcttagggctggagatgggagtggggattaactgccagtgcgcaagagagaacttgggtgagggaaacatatttaaattagatcgtggtgttgggtgcacacagtatcaatttaataaagcatcaaattctagaccttttcagtgggcaaactttatggtgggttcacacccaatataggtgttaaaaataatgttacggaaattcttgtcgggtttttaacaagccaagagatatgctgtgaaagcagcattaattcaagtggttgtcacaggtcacttaaagttaatcagatagttgtcctacaaatatagggtgaatgttattcatgaatttcctgaatctattgcaataatcacatttttttccattaaactcttgaggtagctaattttatttattgcattttcaatgttaatctactatttcatatgttgagattaactcacattagtcagaatttaaagtattttaaaatatcacagaatttaatttaccttatctggttttggtttcaagactatagtagccatttcatttaattgtacatgtagggtattctaatttatggaaaactattacattttccttgatttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccattgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacacacctgacaacaaaaaatcaacaactgtaaaagagccacaaaatccccaaatatttgcaaattagcaatgcacttttaaataactgttgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgcagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttatttatttatttattttgagatggagtttcactcttgtcacccaggctggagtgcaatggcatgatcttggctcactgcaacctctgcctcccgggttcaagcgattctcctgcctcagccttctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacacacggccatatgctcagtttttatgtcaatttaaaactctctaaagaaatatattaattgaaaaataataatatagcaccactctttcagggagatctatgcttatgtttaacaaccaggtaagttctagacattagcttgaagcattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagatgctggttaatgcattgacaatagatagggctgttgacatcttgctgacagaagaccagagggaaaatagtgataatctgttctaagtttaaacttatgatcctttttttacaggcttccaagcagagcccactgaatcaaagttgggtttcaggaagatcacggagttcagtgagcactcaacacctctatcagacagactgcgtgggcagtgccttcctggagaggggaacacagccggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaagccctacttcttagtatcacagtacagggctaaaaaatcactaaatacaggaaaaccttagagaggactggtacttcagtaatgttctctaagtgtttactacatgccaggaggaataagctggacacttagcagtggcggaatatggagggggaacttggatggctccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccacagacccaagagacccctcactgtctttctccagtcctcctagcccaaggtgtgtgggtggacaaaggtggtgctctggaggaaatgcctgagataaggacaggtccttaatgataaagaattctccttcctctttcagatccttgacctcccagtatgacagcttaaaggctgtcatctctgtggcctgcctccccttgcccttcaccctgccagctgcctctcagtgactgtctcctccagtgactacactgagggaccagggactgcttgcctcccgaggctgctcacaccttctgacaccgcaaaatgattgtcaaaaatgggtctgcaaagagtaacttcccttccactgatcaaacctgaatatgcaagctactgtcaattaactggaaaagtggccgtgtgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccaatctcattcactaacctcaccatagtcttatgggttcaatggacctgtccaatcctttgctctgttctctccatcaccttcctgtgtaattttcctccaccacgcacataatagaaacatggcacaggggagctaatcgcctcttttatcccccacttcaggctcacacataagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaagggaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagaggttgtagttcaggccttcaacattagcaccgtatgaggaaacattttgactcttcactatgcagcaagtgaaccagagcacatttatttatgtggcttagtttctccatctggcatgtgggctcaataaacaagctcacaacatatgggcatgatgatgatgaggtgtgaactaatgtaagtaaagtatgtggtctgatttgttaaattaagaaaaatggcactgagagttgtgctgggtaaacacaacatttttttcctgggggaaacacagatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccggacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagattggaaataaggttcaagtcaaaagccccaactctagagtagagttcccttaggaaagcacaggagcttttcttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacacgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaacacatgctacgattcaaccacagcatcctgtcacttcttcagaccctttaaaagcccagcaggactgccactaccttcttgacatcgaccaagtccctttcaacctccacagacccacatacactgctactgcatttatcatggagggtatagggttctgccctgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaatcaaactgtatgttcttagttaatagtctctataaattcactctatttatctttctgagttgaaatactgcatctcattggataacaaaaaaaaaaatttgactaagattacactggaaaggtgagtaggttgggtgattgactgtgattgacaattccatgattctggataacttccaaagcataaaaataaatgtgtgttttctttcacacgtagacaatacacatgcttattactttaaaaaattaatatgtgcatggaagtgacttactacaaatatattaaagtaaatacacatttcacaaaaaaagaagagaggaagggaaaaacatgttaaaaacaaagagagttacattttattgtgtgaaaagcctccaacggatccttactactgtggctttgttccaaagttttggaaagtaatgatttcataggttcttaattgggttaaaaacagcattaaaatagactctgccatattctcccctggggaataacttaatctgtggggtggggaatggaacgttgaaggatgcaggatgtaaaaggaaattatatatatattatatatattatatattatatgatatatataatatatatattatttattatatatattatatgttatatataatatatataaataatatataatgtacataatatataattatataatatatattatatattatatattatatacataatatataattatataatgtataatatatattatatataatataatatatattatctataatatatataatatattatatatattatatattatatttaatatattatatatattatatatataatatattatatataatatatataatatattatatataatatattaaatacattatatatatattttatatatatatatattttttatatatatatatataatatatatatataatttgggaatttgggaataaactgaatcccaattcacactgggactacaccagctgccaccatgcctggctaattttttgtatttgtagtagagacagggtttcactgtattggccaggatggtcttgatctcctcaccttgtgatcctcttgccttggcctcccaaagtgctgggattataggcctgagtcaagatacatattttttaaatgaagaaaaatttgaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacaggtagtggcacttacgaccaagggcaggagatccctaatcccatcaccatggcgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcccacacattattatgctggcttcttaaaataagttgtgagatgggaagtagggcacccacaaatatatatatatataattatatataatataatatatagtatatatataatatatttaatatattatatatatatataatttgggaatttgggaataaactgaatcccaattcacactgggactacaccagctgccaccatgcctggctaattgtttgtatttgtagtagagacagggtttcactgtattggccaggatggtcttgatctcctctccttgtgatcctcttgccttggcctcccaaagtgctgggattacaggcctgagtcaagatacatattttttaaatgaagaaaaatttcaaagttactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcagaatcagggaaaatgaaaccacaatggttcaatctgctctgacctttgaaaaactcagcacagatactggcacttaggagcaagggcaggagatccctaatcccatcaccatggcgatagggcataaacattccagggtgaaggcacaatccacactgtgaggtccaactgctgccgtgcagacaggagggcttttacaagtacaggaaggtcatcaaaggctcagtgttttctttcaaaaactgaatcccaagcccacacattattatgctggcttcttaaaataagttatgagatgggaaatagggcacccacaaatatatatatatataattatatacaatataatatatataatatatataacatatatataatttccttttacatcctgcatccttatattatatataatattatgtataatataatatgtattattatatataatataatatatatgaatatatataattatataatataatatgtaattctatataattctatataatataatatatattatatataaatatatataatatactatattatatataagtatacataatatattatatatacgtatacataatatagtatattatataaacatatatataatatattatatatacgtatatataatatattatatatacgtatatataatatattatattatatatacgtatatataatattatatatacgtatatataatatattatattatatatacgtatatataatattatatatatattatatataagtatatataataatgtaatatattatatataagtgtatataatgtaatatataatataatataataatatattataatatattatatattataacataatataatataatatacattataatataatatataatattatatataatataatatataatataaaataatataatatataatataatatataaaataataattaatattttaaattaattattattaattaatattaattaatattaaaaataatataaaatataattactataatataatctataattattatatataatataatatacaattatatataatattatatataataaaatatatataattatgtgtatttattacatataatataatacataaattatatataattattacatataatataatatataattatatataattattacatataatataatatataattagatataattattacatatgatataatatataattatatataattattacatatgatataatatatataattatatataattatataattatatatacaagataataatatataatatataatatatattacataatattttatataatatattatactatatatattatataatattttatataaaatattatatattatatataatataatattttatataaaatattatatattatatataatataatattttatacaatataatatataatatatattatattatcatatgttatacaataatatgttatagtataatatatattataatctaatatattatatattattatatattatattatatataacattatatagtattatatattttataataataatataatatataatattatatattatatataatatataatatattatgacatattatatataatatataatatattatgaatatattatatataatatataatatattgtgatatatattatatattatataatatattatgatatatattatatataatataatataattatatgtaatataatattatatatcttatatatcacatattatatattttatatcatatactatatattatatcatacattacatataatgtatgtcacatattatatgtaatatatgtcacatatatgtaatatatgtcatatattatatataatatatatcatatattatatatgtcatttattctgtaatatgtatcatacatattacataatatgtattatggtgtctggtggtcccaggacacagactgatgtcactcagcctcacatgacactctgtcctcaccacacttggggtcctgggagtcgtagcaccaggcacctatagagacagtgggcaggaggctgagctgagagaccagtcatctgggtcctctccaagccccatcccatcaactggggtccaagaatgaagtaggccaggggcttaggccaggggaggccagtgaagaaccttctctcatgtcacccctaccccagtattttctctccccagtccctccccactcccagtggcaagacctaaggggtggtggagcatggcaagagggtagattggagaccagacgggaagagtcctggtgctcactctcagagtctgcaccacaccagctgcaccgcaaggcgagcatgatgccaggggcgtgcgtggctcagtggcagccgcagctaggaaggactagaaagtggctagaccgcggagccaagatgctggcctggctactacatatttattcattagctagctgggctaggggcgtggctattgaggagaggatgggaggggtcggtgcccaggcagggccaccaggaagagcgggagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgcccatgactttcggggcaaggatgggaggaaggtgtaggatgtctcttgccccgctgtgggcctggaactgccaccccatcccaagaccatagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctggaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtctcgaatgcctgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtccgtggtcacacagctcagggcaggtatttattagtacatgaatagcttagctgtgtcatagtctttatgtgaaaggcacaaaaaaaggcactttggcaggctgaaagtgtggggattataggtgtcagccaccgtgcctagcccactggatgacttatgatatcatatgtgacattgtgacatcatgtgagtcagggatgtaccccgttctcagctgctatatgctatgttacactgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcacctgaggcaggagaattgcttgaacccaggaggcagaggttgcagtgagctgagattgcaccactgcactccagccttggggacagagtgagactgtatctcaaaaaaataaaataaaataatctaggacaaccaagagaaggactcaggctcaccttactccatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgcaggcctgattcacagtgtatgtgagtcacaaatgtcacttatgacaccatacagcaggtgagaggggatagtcattactcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggagatgcagacacaaatcacactgtgtgctgtatcccatatatgtgtttaatttctgtgtttaagagagctgggttcatgaatgaacttagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgctcactgatacatatttgctccgtactgaagtgaggcagatgcatgagtgattgagaataatgctgccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagtatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccgatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccgggcacagtggctcatgtctgtaatcccagcactttcgggagccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaattggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttggggtttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggccggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccctaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagacgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagaatttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaatgtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggtggaggttgcagtgagccgagacagcaccattgcactccagccttagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaacatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatttatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaacgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttcctgttttttttttttttttaattatactttaagttctggggtagccgtgcagaaagtgcaggtttattacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctcattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagcgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcactttaaataatgtacaaaatctacaaaaatcatatttaccaggacacatctgttaaataaaagcattgtttcgtgttggtatacatatatacaagactatgtataacagactgtttcccctccctgcaaccacagaaccatcacacacaggcacagatacacgtcagctatgccgctttccacgaatgcatggaacccaggacgcgaacccacagctcgaggtcttataccttcactactgagctgccgccactgcagcagcaacacctctgcggaggtgttgctgaaatcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacaaggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacacttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagccgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccaccctagcggcgccctcccatcccggggcctcgctggctgtgccctggatggaaaggtcccgcccctcatggccgggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgtgtgttttctgcacctggtacagctggatggcctcctcaatgccgtcgtcgctgctggagtcggacgcctcgggagcctgtacggcgctcgtgactcgctttcccctccttgcggtgctggcgctccttttaatcccacttttattctgtactgcttctgaagggcggtgggggttgctggctttgtgctgccctccttctcctgcgtggtcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttgggtctcatgctgtcttttctcattcagaaactgttctatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttcccgcttacatctactgcctccgcccgcagccctggaaggctgtgcatggctgggccccgctggccccgggctgtgccgctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggcgggacagaggcctcccatttgggctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggggagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcactgcaagctctgcctcccgggttcaagtcattctcctgcctccgcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggtttctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctaggaagtccataatatgtttgacccacttcatggtggtgtcctataaatcccaaaggtttttacttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggcttactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggcgtccgccacggcacccagcttgcattttcattttattcattgtattcttcagttctagaatttctgtttggttcttattatttctgtatctttattgaacttttagctttgctcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacagactttcattaatgtctatgaagaagcaaatacctcttctttttttttttttttttttttttttttgagacagagtcttgctctgtcacccagctggagtgcagtggtgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatattacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgagttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggtatgtaaaggcatcactgaattcctgggcaggcatgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactggtaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacatctgtaatcccagagtaatttgggaggctgaggcgggtggattgcttgaagccaggagcttgacatcagcctggccaacatggtgaaaccccatctctactaaaaatacaaaaattagctgggcgtggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagatttaaaaaagttcacaaattagtagaatttaaacaacacactctcaaacaaccaatggatcaaagaaatcacaaagaaattataaaattcttaaagacaaatgaaaatgaaagcacactatatccaaacttatgggctgtggccagttgtggtggctcacacctgtaatcccagcactttgggagactgagggaggtggatagctagaggtcaggagttcaatttcagccaggccaacatggtgaaaccctgtctctactaaaaacacaaaaattagctgggagtggtggtacgtgcctgtagtcccagctacccaggaggctgaggcatgaaaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgcctgtctatgttttagagacaaggtctagctctattgccctggcaacaatcagatgcaaccagaatcagtggcacaatcggctcactgcagccttgaattcctgggctcgccactatgccagctcttttttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactgtaagaaaataaaacaacagatcaatatgcctctgatcattgatgcaaaaactctaaaaatgctagtatactgggtggggcacggtggctcatgcctgtaatcccagcactttgggaggctgaggtgggtggatcacctgaggtcaggagttcaagaccagcctgaccaacatagagaaactcttgtctctactaaaaatacaaaattagccatgtgtggtggtgcatgcctgtaacctcagctactcgggaggctgagacaagagaatcgcttcaacccgggaggtggaggttgtggtgagccgagatcatgccattgtacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagttttacattatatgcacataccacgattcacttttccattttcctagtaatgagctttaagattatttccaatttttagctattaccaataatgtttcaacaaacacctttggacatctcttctgcaaatgtgtgtgtattctcttggagaaggtttaccctgtggaatttctagtgtgtatgtgtatgtgtgtgggtatatatatatacacatatgtatatattttcaactttactatatatttccaaaaaactcttcaaagtggcagatttaaactccccttcgccgtgtataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtgtagtagttcttaatcattttttctactatattatttattttatatcatgaatttgtagaaatcctctttatataatggatattatacttttcaattatatattttgtaaatattttacccaattttctggcttgcatttaacctttatttaggatgcctaggatttttcattttaatacagtctaatttatttttcttttcttttcttcttcatgcattctggcatttgattaataagccatttgttgcccaacgtcattagttctctgtatatacttttaaatatcttaaacatgtaatattcataagtaatttcacaagtagtttaagatttgagtctttaacctaaatagatacaggattttgtgatatgctgtaatatacagatttttatttatatatggataaaaatttatatgttttttctgacatcatttattgaatagtataatttttctactgacttttagtatcatatcttttattacaagtccaatgtattcagcatatctatggatctatttcttggtgcttccattttttcccattgtttaacggtgtatcactgagccaaagcaaaccattttaattattataattaaaacacatttaaatattgataggctattattgttcagaataactttggttcttcctttccattgattattttaatatgacttttccaatcaagttctaaaaaaatactggtggtatatttattgaaataactttaataaaattaaatgaaagatcatgtgttttctgaattaattcttagatacgttaatgttttatgttaccatgaatgtgatattataatataatatttttaattggttgctactgtttataagaatttcattttctctttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctataatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttattttttttcctacatctgctaaggtaatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctagtatatttaaactattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaaacaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttgttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggattcggcccggtgtggtggctcacgcctgtaatcccaatactttgggaggccaaggtgggccgatcacgaggtcaggagatcgagaccatcttggctaacacagtgagaccccatctctactaaaaatacaaaaaattagccatgtgtggcggcacacgcctgtagtcccagctactcgggaggctgaggcaggagaatggcgtgaacccgggaggcagagcttgcagtgagccgagatcgcgccactgcactccagcctgggcgacagagcaagactccatctcaaaaaaaaaaaaaaaaaaaaaaagagtgcaatggaaagctggtagaaaatggacattgtttaaagaccaaaacaaccacactactttgctaatccctatcagctaaagcctagagaatatatgaggtatagatttacatggtgtttgactaaggcatgcagaatataatcttgacataggctaagtttatcaacatagatacatagagattctgaagttaaagtcttagcccaagaagttagaaggggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcactgtgtcccacaggaagcccagaagatgtttctctaagaaattaaggattcgtttgttggggagggctgctggcatgcttgaaaagtactgtgatggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatgtgactgttagggatctttgatgaaggctgattctcagggagtgaactacatcagtgaccaactatttgtctttatataactgggtaatgtggatggattctaataaagggactacttacagcacagcaggaaagtcacaaagaaaccagacagaagagtgtaagtagtaaggggccaagcagtcacctgactagagacagtgccagcttgccaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattctgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcctgttaggaactgggcacaaagcaggagatgagtggctggccagccgaacattactgcctgagctccgcctcctgtcagatcagcagcagcattagaccttcacaggagcacaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaagaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggttagaagttcgagaccagcctgaccaacatggagaaactccgtctgtactaaaaatacaaaattagctgggcgtgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaacaaagaaaaaaatatatatatattacaaaatttaaagagagtggtacaccagtaaaggacatttagcatgaacagaggttgcaggactggcagatgctctgatgagtcagtgagtacctggtgagtgaatgcgaaggcctaggatattactgtacataactatagactttatatgcactgtacacttaggctacactaaatgtatttaaattttttctttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagtcctgtaagggtcaggataatcaatatcactgtcttccatctcgaaatcttgtccaagtgaaaggtcttcagggtcttcagtggcaataacatacatgcagctgtcattctctatgataacaaggctttcttctggaagaactcgtggaagaccttcctgaagctgtttcatagttaattttttttaatgagtagtagtactacactctaaaatatgaataaaatctgtagtattatacatactgttgatccttgaacagtgcaagggttaggggaccagctcctgtgcagttgaaaatccatatataattctgggctatccccaaacttaacttaatatgatatatatcatatataatatatatgatatatatcgtatatattacatatgatatatatcatatataatatatacgatatatatcatacataatatgtatgatatatattatacacaatatgtatgatatatattacatacaataagtatgatatatattatatacaatatgtatgatatatattatatacaatatatgatatatattatatactatatgatatagattatatacaatatatatgatagagattatatacaatatatatgatacagattaaatacaatatatatgatacagattatatacaatatatatgatacagattatatacaacatatatgatagattatatacaatatatatgatatagattatatacaatatatatgatatagattatatacaatatatatgatatagattatatacaatatatatgatatagattatatactacatatgatatacatgatatatcatatatatgatatacatggtatatcatatatgatatatacgatatatcgcatatatgatatagatgatatatcgtatatatgacatagatgatatatcatacctgatatagatgataaataatatatgatatagatgatatatatcatatatgatatatcatatattatataataaatgatatatattatatataataaaagatatatattacataataaatgatatatattatgtaaaatatatgatatatattatatattatatctgatatatattatatattatatattttatctgatatatattatatattatatctgatatattatatataattatattatattatattatatattatatattttatattatatgatatataattatattatattatattatattatatatattatattatatataattatattatattatatattatatattatattatatataattatattatatgatattatatattatatataatttatgatatatattatgtattatatataatttatgatatatataatatattatttatcatatatcatatatattatggtatattatatataattgtattatatataataatatataatataccataatatatcatatattatataatatataatataatataatataatgtaatcatatataatatataatatattatattataaaatatattatattatgatatactatatattacatgttacattatataatattttgtataatatataatatatattatctattatactttattatattacatatataattatacattattatatttcatatataattatataattatacataattatatatattatattatatataatgttatgtataacaatatatattatacataatattatatattatattaaatatgatattatatataaggatgcaggatgtaaaaggaaattatatatatgttatatattatatatattatattatacataatatatatatatatttgggggtgccctatttcctatctcataacttattttaagaagcacagcataataatgtgtggacttgggattcagtttttgaaatgaaacactgagccttcgatgaccttcctgtacatgtgaaagcacacctgtctgcatggcagcagttggacctcacagtgtggattgtgccttcaccctggaatgtttatgccctatcgccatggtgatgggattagggatctgctgcccttggtcctaagtgccactatctgtgctgagtttttcaaaggtcagagcagattgaacctttgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattattgtaccaagcagagtacctttgaaatttttcttcatttaaaaaatatgtatcttggctcaagcctgtaatcccagcactttgggaggccaaggcaagaggatcacaaggtgaggagatgaagaccatcctggccaatgtggcgaaaccctatctctactaaaaatacaaaaaattagccaggcatggtggcagctggtgtagtcccagtgtggtgtagccccagctacctgggaggctgaagcaggacaatcgcttccacccgtgaggcagaggttgcagtgagccaagatggcaccattgcattccagcctgtgcaacagaacaagaatctgtctaaaaaaaattatatatatataatgtatattatatgtactatatattacataaaacatataatatataatatatataatatatataaaatataatatacattatatataaataatatatattatatgtcacgttatgtaatatctatgatacatattacataataaaagacatatataatatatgatatatattacatataatatatgatatatattacatataatatatgatatatattacatataatatatgatatatattacatataatatatgatatatattacatataatatgtgacatatattacatacaatatgtgacatatattatatgtaatatatgatatataatatataatatatggtatataatatataatatatgatatataatatatgatatataatatataatatatgatatataatgttatattacatataattatattatattatattatatatatcataatatattatataatatataatatatatcataatatattatataatatataatatatatcataatatattatgtaatatatataatatatcattttatatattatatataatatgtcataatatattatataatattatatataatatatcataatatattatatattatattattataaaatatataatactatataatgttatatataatataatattatattagattataatatataatattatattagattataatatataatattagattataatatataatatattagattataatatacattatattataatatattattgtataatatgttataatataatatatattatatattatattatacataatattatattatatataatatatataatattttatacaacatattatatataatatcttatataatatattatacaatatattatattgtataatatattatatatattatgtattattatcttgtatatataattatatataattatataattatatatattatattataggtaataattatatataattatatattatattatatgtaataattatatataagtatatattatattatatgtaataattatatataatttatgtattatattatatgtaataaatacacataattatatatattttattatatatattatgtataattgtatattatattatatataataattataggttatattagatatattaattgtattttatattatttttaatattagttaatattaattaataataattaatttaaatattaattattattttatatattatattatatattatgttatatattatattatatattatattatattatatattatattatattatatattatattatatattatattatatataatatagataattatatattatatatcattatatataattacatatattatattatattgctatatatattcatatatattatattatatataataatacctattatattatacataatattatatataatataaggatgcaggatgtaaaaggaaattatatatatgttatatatattatatatattatgtcatatataattatatatatatatttttttgggtgccctatttcccatctcataacttattttaagaagccagcataataatgtgtgggcttgggattcagtttttgaaacaaaacactgagcctttgatgaccttcctgtagttgtaaaagccctcacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaacgtcagagcagattgaaccattgtggtttcattttccctgattttgatttttcttatggggaacctgtgtggctgcattcaaggtatgttcttactggcctgtcaaatgcgatcttttcaaattactagttaatactttcaaaatatattatttaaaaaattagcctctgtattttccatatgcagttataaatatgtttcatgattatgttttattcctcaatttatatatttgattattgtaccaagcagagtatctttgaaatttttcttcatttaaaaaatatgtgtcttgactcaggcctgtaatcccagcactttgggagcccaaggcaagaggatcacaaggtgaggagatcaagaccatcctggccaatacagtgaaaccctgtctctactacaaatagaaaaaattagccaggcatggtggcagctggtgtagtcccagtgtgaattgggattcagtttattcccaaattcccaaattttatatatatatatatataaaatatattaaatatattatatatatactatatattatattatatataattatatatatatatatttttgggtgccctatttcccatctcataacttattttaagaagccagcataataatgtgtgggcttgggattcagtttttgaaacaaaacactgagcctttgatgaccttcctgtagttgtaaaagcccacctgtctgcatggcagcagttggacctcacagtgtggattgtgccttcaccctggaatgtttatgccctatcaccatggtgatgggattagggatctcctgcccttggtcctacgtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattactgtaccaagcagagtatctttgaaatttttcttcatttaaaaaatatgtatcttgactcaggcctgtaatcccagcactttgggaggccaaggcaagaggatcacaaggtgaggagatcaagaccatcctggcgaatacagtgaaaccctgtctctactacaaatacaatcaattagccaggcatggtggcagctggtgtagtcccagtgtgaattgggagtccgtttattcccaaattcccaaattttatatatatatatatataatatatataatatataatatattatatatattttatataatatataatatatataacatatatattatatataatatatacattatatgtaatatattatatatattttatattatatataaaatatatatactatatataatatatatagtatatataatatatattatatataatatatatagtatatataatatatattatatataatatatatagtatatataatatatattatatataatatgtataatattatatattatatatattatatatattatatattatatattatgtatataatatatattatttatatattatatataatatataatatataatatataatatataattatatattatatatattatatattatataatatataataaataatatatattatatatataatatatatgatatataattatatattatatattatataatatataatatataataaataattatatatcatatatataatatatataatatatataaataatatatattatatacataatataattatcatatattatatatatgtcatatataatatatgtcataatataatatatgtcataatatatataatataatatatgtcataatatatatataatttccttttacatcctgcatccttcaacctgcatccttcaacgttccatcccccaccccacagattaagttattcccctggggagaatatggcgaagtctattttaatgctgtttttaacccaattaagaacctatgaaatcattactttccaaaactttggaacaaagccacagtagtaaggatccgttggaggcttttcacacaataaaatgtaactctctttgtttttaacatgtttttcccttcctctcttctttttttgtgaaatgtgtatttactttaatatatttgtagtaagtcacttccatgcacatattaattttttaaagtaataagcatgtgtattgtctacgtgtgaaagaaaacacacatttatttttatgctttggaagttatccagaatcatggaattgtcaatcacagtcaatcacccaacctactcacctttccagtgtaatcttagtcaaatttttttttttgttatccaatgagatgcagtatttcaactcagaaagataaatagagtgaatttatagagactattaactaagaacatacagtttgatttatactcagaagcaagtagattatgtacatatatatgaagataaaaattaaaaggataattgtgtaaatttgcatgtagagggctttgaaaacctgtttacttgtgaatgctgttttgatgtattgtgtctttgttctcccgacccatcatccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacagggcagaaccctataccctccatgataaatgcagtagcagtgtatgtgggtctgtggaggttgaaagggacttggtcgatgtcaagaaggtagtggcagtcctgctgggcttttaaagggtctgaagaagtgacaggatgctgtggttgaatcgtagcatgtgttttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcgtgtgaaaaggaagccctactctaccaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaacaaaagctcctgtgctttcctaaggcaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatgtttcttaatttaacaaatcagaccacatactttacttacattagttcacacctcatcatcatcatgcccatatgttgtgagcttgtttattgagcccacatgccagatggagaaactaagccacataaataaatgtgccctggttcacttgctgcatagtgaagagtcaaaatgtttcctcatacggtgctaatgttgaaggcctgaactacaaccactatttatcagccagtgaagagatcactattcaccatgcaagggagttccagcaccctctatgcctggaattacccacgcctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagactggtcattttaggtcaaattttacccagagctggtgcagccactgcccattcttagccagaccttattgcaggcagctctgatcaatagtcaaggaggcagtgggggttgcagacttaattcattaaatcaccaaagcaccagcccacacggccacttttccagttaattcacagtagcttgcatattcaggtttgatcagtggaagggaagttactctttgcagacccatcttttgacaatcattttgcagtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcatcacctttgtccacccacacaccttgggctaggaggactggagaaaaacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagtcacagcccctcctctgcaccccctgcagggctgatgttctccataaaccataaggcatcatgcccacggaaaagccgaacaggaaagcatgctccactgccccggagccatccaagttccccctccatattccgccactgctgagtgtccagcttattcctcctggcctgtagtaaacacttagagaacattactgaagtaccagtcctctctaaggttttcctgtatttagtgattttttagccctgtactgtgatactaagaagtagggcctaaatagggcctaaaaagtattgctaaaattacattatgacagtgcagagaactgagggcagagggaggacatgagcttgccaggtccacatggcttagtggaatttgaatccgggcccctactctgcaccagccctgcactcacagtcatcctgctgtattctcctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcctctgtcagcaagatgtcaacagccctatctattgtaaatgcattaaccagcatcttctctgatagagaatataagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgtgtgtggtggctcacacttataatcccagcactttaggaggccaaggcaggcggatcatctgaggtcaggagttggagaccagcctggccaacatggtgaaaccccatctctactaaaaatccaaaaaaattagccgggtgtggtggcaggcgcctgtaatcccagctactcaggaggctgaggcaggagaatcgcttgaacccgggaggcagaggttgcagtgagccaagatcatgccattgcactccagcctgggtgacaagagtgaaactccatctcaaaataaataaataaataaataaataaataaataaataaataaaaattgagtatataatacacgaagttcccatattattctgtctcctcaccctcacttcctaatttcacctattagtaacatcttacattactgtggtacatttgctagaataatgagaaaatattgacacattattatctgaagtctgcatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcgctcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtacttttaattttctattgagacttcttctttaacccaacagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaatggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaaatcaaggaagatgtaatagttttccataaattagaataccctacatgtacaattaaatgaaatggctagtatagtcttgaaaccaaaaccagataaggtaaattaaattctgtgatattttaaaatactgtaaattctgactaatgtgagttaatctcaatatatgaaatagtagattaacattgaaaatgcaataaataaaattagctacctcaagagtttaatggaaaaaaatgtgattattgcaatagattcaggaaattcatgaataacattcaccctatatttgtaggacaactatctaactttaagtgacctgtgacaaccatttgaattaatgctgctttcacagcatatctcttggcttgttaaaaacccgacaagaatttccgtaacattaatttatttttaacacctatattgggtgtgaacccaccataaagtttgcccactgaaaaggtctacaatttgatgctttattaaattgatactgtgtgcacccatcaccacgatctaatttaaatatgtttccctcacccaagttctctcttgcgcactggcagttaatccccactcccatctccagccctaagcaatactgctgtgacattccatctccataaatttcccatttgcttaatagaaatggacatatatatatatttggaatctgacttccttcatttagcatactatgtttgaagttaattgacgtgttagcacgtgctggtcatgtgttttccttcatagtctgctgtgtttactcatacagatagtgtttattcatttatcagttaatggacatttaattgttttgttattttctttgatgagtaatgtagctttgagcattcatatacagtcatgtaatgcataatgacattttggtcaaaaaaatttttttttttctgagacccaggctggagtgcagtggcacaatctcggctcactggaacctccacctcccaggtttaagcaattctcgtgcctcaacctcccgagtagctgggacaactggcacacgccaccatgcctggataatttttgtattttcaggagagacaggattttgctgtgttggtcaggctagtctcaaactcctagcctcaggtgatccacccatctctgcctcccaaagtgctgggattataggcatgagccaccacacccagcctaatttttttaagaaagaagggaactattttctaaattacttttgccaatttatatttctaccatgatgcatagcactaatttcaccgtacaatgtatggtaggccccaatatgtaagaaatgatgaaagtaacacataaagattggtataaaacaaataagattatcattgttgctatcatctttgtcaaattctgaaaacaatctgagtatatttttatataaatatgcttggcaacatagctgaaaaacgcattatcagttacatttatcagtaacaaagacataaatttgaagggggaaaaacacttgtactaacaacgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagcgaggtgccttggtgtgtgtggacgtaccattatgcttggaggtacagcataatggtggcttcctccagaaagggacatttggggtggattcattccatctagacaacacagcctgatgtggcatggacatgaatggaggtgaaatggtcagtagttgagaggatcagtcctgacaagggccgaggtgaaaaacctgggaaccccttcaggtgcaaagtcttcagttgaaaaaggaggtggtcacaggaaatactgagacaggacagcaaagcatgggagacagagttcttggccctgcagggtgagtactgtggattctcaaattttctcctctctccattaatttctttcccaatgcagatgacttccatcatacagtcttcagcaatcttgaaagattggacaagcttcagcccactcttgaaggtaaaggaaggcagctaacaagactggcatctgggcttggctgtgcgtgttttctatcgtggggaaatatatataacacaatatttatcatttgaaccttttaaccaaagtgtgcactccatggcattcaatatattcacagggttgcataaccagcaccactatctacacccacaattttgatgatttcttacgaaaccttgtccacaataagcaatatagcaccttccccctatttccagcccatggtgattcctatcccactttctcttgtatgaatttgactattctaggcacttcatgtaattacaattatacaatatattccttttgtgtctggcttatttcactaagcataatgttctcaatgtccacccatgttgtagcatctatcaaaatgatgttcgttttttacagatggatgatgtagcattgcatgcagaccactttgcttttattacattcatttgttcactgatggttggattatttccaccttttggctcctgtgaaaagtgatgctacaaacattagtatacaaacatctgtttgatttccgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttcttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgttgtagatttttgaatatatcttaaatatatttaaaatatattctaaattttagtctcttacaagataaatgatttgcaaatatttccacctttgtgtagaactttagattcacaaacttcattaatttgtatgaaatcctcggcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgtttagttcaccacacttgttgcaactgtttgcgctgcagagttaaaacacaccagcattcaacccatgtctcctctcttgaagtaaactgtcgtatgttggctggcctgaacaagcgtagatattctccatcctcaattaatatgcatgcatgacaaagaaaaggaggcctggatgaaaaaatattgtgtgattaataattatgctttaattaattttaaaagatataatttcagtacttctaattctcccatcagcagttataacaaaggattagtgaataaataccatagactgttttgcctagaatcgaatccaatctgtctattaaactttgcttttattcaagtgcaaaatgctaaaacacataataactgcagtgacagccactgtggatcctcagaggtaaaagtagtcttgggacataaatcctgcaagctaatatcgtttttacagggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccaccagggaagattttctagcaggagctcaagctgtgcttttaatgaaacacatccacacacactgtcctgttgtccacattgagcagagctccctgaataactcatgaacaaaagcatctatgactaactgttgctctgtgtcctcttagcctctgaggagtctctagttcacaaggacagaggagatggagagaggccagtcaacgtgagggtaaggttgccttgctttctctgaaatagaaatgttcctttcttggtgtctttctttttcaactgactttacatgtgaaaaaatgacaatgtccatgacaggtattaaatgcagttttctgagggggaggaagaagtgactcttagcaactgatatgtaatccaaaatggcatttagctatgacggcttcaggttgtggactgtatccttggggtccttgtccttggaagcaatgtcttctccttggattcagtattttgcacttgccaacctacgtggacctgagagatacaccgtccagaagctgatgccttttccagtgtgtatcctacccttgttttggaggccttgaagttgactacactttctgatcaagttttcaatattcattgagagaaacacagccttgtgcaaacaatccacaacgtgacatacccctcaaaaagctttgtttctgtattgcaggtggtgcaggtggcccctctgaggcatgaatctagtaagtattctggaatcacttgccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaaactgaagggccaagggagtggccccagctcccgagttcctgaatgaaaaagtgaaaacacgaacccaggagtgtgggccagtgctgacgctgacatggcacttagtcatggggtgttcaccaccacacagggagtccaacattcatgtataagccctaaagcaccgagcccaaaaggccccagacactgcccatcatcataaagtgggctccgtggtcacacaacccaaggcagttataggctcatctccccacagacaggcatagtcatcagtgtgtcaaaagcacaaagatccccaggtgtttggctcagctcaccaatccttttttttttttttttttaacttttaagttcaggggtacatgggcaggatgtgcaggtttgctacatatataaatgtgtgtcatgagagtttgttgtacagattattgcatcacccatatattgagcctaatatcagttatttttcctgatcctccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacacgtgtaaatctcatacatacaacaggcaaatgcagaagcagtgtggtctcgcaagttgtaaagaggacagtcgcaattttgctggacttcaacctgggtagaagacatgagggaactctgtcactgaatcacggcagagttcaaggccacttgcagactatttcatgttatagaaggtggcctttagctactaagcaaaggcctctgtttctcatttctttcctgttcatcttcttcgtcatccttcttccgcaagggaaacgagcccaagcaaaagacagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatctttatgttggcagctaagttagatttaacataactgacaaaaattaaaatttctgatttcttgtaaaaatattttgtatgtgtgaatgcatactgaatgtaaagtggataaaaaaaatcacacttgcactcatggaaggcttttcatgaatttgtcaatttctatttttttatatttccccatttcaccggataatacatacctgaacctggaaaatgattcccacagcagaaagtgttctgagccacatcccttagcttcactagtgcaggtccacctgggagtatgtcccaccatcagcttgacccatgctgtaatcagccacctccatgcatcacaccaagcaagcccctgggtgattcacagtctccagcaccagggcactgaccttaactctgtgttcttctagctccctatgaggacactgtacacgacatcgctaatgaggacgctgtatatgacattgctactgaggacgccatatatgacatcgctaacgaggacgccgtccagggcatcgcaaaggaggacgccgcccagggcatcgctaacgaggaagccgtccacgacatcgctaacgaggatgccgcccacgtaatcgctaacgaggacgccgcccagagcatcgctaacgaggacgcggtccacgacatcgctaacgaggatgccacccagggcatcgttaatgaggacgccgcccacaatatcgctaatgaggacgccgcccacggcgtcgctaacgaggtcgccgcccagggcgtcgctaacgaggacgccgtccactgcatcgctaacgaggtcgccgcccagggcgtccttaaagaggacgccgcccaggacatcgcaaacgaggacgccgcccagggcatcgctaacgaggacgccgcccacggcatcgcaaacgaggacgcagcccaggacatcgcaaacgaggacgccgcccaggacatcgcaaacgaggacgccgcccagggcatctctaaggaggacgccgtccagggcatcgcgaacgaggatgccgcccagggcatcgctaaggaggaccccgtccagggcgtcgctaacgaggaccccgtccagggcgtcaataacgaggacgccgtccagggcatcgctaaggaggaccccgtccagggcgtcgctaacgaggaccccgtccagggcgtcgctaacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggttgccgcccagggcatcgctaccgaggacgtcgccgacggcatcgctaacgaggacgccgcccacggcgtcgctaacgaggtcgccgcccagggcgtcgctaacgaggacgccgtcgagggcgtcgctaacgaggacgccgcccagggcgtcgctaaagaggtcaccgcccacggcgtcgctaacgaggacgccgtccagggtgtcgttaacgaggacgccctccacggcgtcgtcgctaacgaggatgccgcccaagcgatcgctaagccggacgccgcccatggcatcgctaacgaggtcaccgcgcagggcatcgctaacgaggtcgccatccacagcatcgctatcgaggacaccacaccgtccagggcgtggctaacgaggtcgctgcccagggcatcgctaccgaggatgtcgccgacggcatcgctgaggacgccgcccatggcatcactaacaaggaggccgcccaggccatcgctaagcaggatgccgcccacggcatcactaacgaggacgccgtccagggcgtcgctaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgcccagggcgtcgctaacgaggacgccgtccagggcgtcgctaacgaggtcgaagtccagggcatcgcacacaaggacgccatccagggcatcgctaacgaggatgccgcccacggcatcgctaacgaggtcgccgcccacggcatcgcaaacgaggacgctgcccagggcatcgcgaacgaggacgccgcccagggcatcgctaacgaggtcgccgcccacggcatctctaaggaggacaccgtccagggcatcgcgaacgaggacgccgcccagggcatcgctaaagagaaccccgtccagggcgtcgctaacgaggaccctgtccagggcgtcgctaacgaggttgaagtccagggcgtcgcacacgaggacgccgtccagggcatcgctaacgaggacgccgcccacggcatcgcgaacgaggtcgctgcccagggcatcgcgaacgaggacgccgcccaggacatcgcaaaggaggatgccgcccaggacatcgcaaacgaggacgccgcccagggcatctctaaggaggacgccgtccagggcatcgcgaacgaggacgccgcccagggcatcgctaaggaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatagcacatgaggatgccgtccagggcatcgctaacgaggacgccgtccacggcgtcgctaaagaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaatgaggacgccgcccacggcgtcgctaaagaggtcaccgcccacggcgtcgctaacgaggacgccgtccagggcgtcgttaacgaggacgccctccacggcgtcgtcgctaacgaggatgccgcccaagcgatcgctaagccggacgccgcccatggcatcgctaacgaggtcgccgcccacggcatcgcgaacgaggacgccgcccagggcatcgctaacgaggtcgccgcccacggcatctctaaggaggacgctgtccagggcatcgcgaacgaggacgccgcccagggcatcgcgaacgaggacgccgcccagggcatcgcacacgaggacgccgtccagggcatcgctaacgaggacgccgtccacggcgtcgctaaagaggtcgccgcccacggcgtcgctaacaaggatgccgcccacgcgatcgctaagccggacgccgcccgcggcatcgctaacgaggttgccgcccagggcatcgctaccgaggatgtcgccgacggcatcgctaacaaggacgccgtccacggcgtcgctaacgaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaacgaggacgccgcccacggcgtcgctaacgaggtcgccgcccacggcgtcgctatcgaggacgccgtccagggcgtcgctaacgaggacgccgtccacggcgtcgctaacgaggacgccgcccagggcgtcgctaaagaggtcaccgcccacggcgtcgctaacgaggacgccgtccagggcgtcgttaatgaggacgccctccacagcgtcttcgctaacgaggatgccgcccaagcgatcgctaagccggacgccgcccatggcatcgctaacgaggtcgccgcccacggcatcgggaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccctgtccagggcgtcgctaacgaggacgtcgtccagggcgtcgctaacgaggttgaagtccagggcatcgcacacgaggacgccgtccagggcatcgctaacgaggacgccgcccacggcatcgctaacgaggtcgccgcccacggcgtcgcgaacgaggacgccgcccagggcgtcgctaacgaggacgccgcccagggcgtcgctaacgaggacgccgtccacggcgtcgctaacgaggacgccgcccagggcgtcgctaaagaggtcaccgcccacggcgtcactaacgaggacgccgtccagggcgtcgttaaccaggaggccctccatggcgtcgtcgctaacgaggatgccgcccaagcgatcgctaagccggacagcgcccatggcatcgctaacgaggtcgccgcccagggcatcgctaacgaggtcgccgtccacagcatcgctatcgaggacaccacaccgtccagggcgtggctaacgaggtcgctgcccagggcatcgctaccgaggatgtcgccgacggcatcgctgaggacgccgcccatggcatcactaacgaggaggccgcccaggccatcgctaagcaggatgccgcccacagcatcactaacgaggatgccgtccagggcgtcgctaacgaggacgccgcccacggcgtcgctaacgaggacgccgcccagggcatcgctaacgaggtcgccacccatggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggttgccgcccacggcgtcgctaacgaggaccccgtccagggcgtcgctaacgaggacgccgtccagggcgtcgctaacgaggttgaagtccagggtgtcgcacacgaggacgccgtccagggcatcgctaacgaggacgccgcccacggcatcgctaacgaggtcgctgcccatggcatcgcgaacgaggatgccgcccagggcatcgcgaacgaggacgccgcccagggcatcgcacacgaggacgccgtccagggcatcgctaacgaggacgccgtccacggcatcgctaaagaggtcgccgcccacggcgtcgctaacgaggatgccgcccacgcgatcgctaagccggacgccgcccgcggcatcgctaacgaggtcgccacccagggcatcgctacccaggatgtcgccgacggcatcgctaacgaggacgccgcccacggcgtcgctaacgaggtcgccgcccacggcatcgctaacgaggtcgccgtccactgcgtcgctatcgaggacgccgcccagggcgtcgctaaagaggtcaccgcccacggcgtcgctaacgaggacgccgtccagggcgtcgttaacgagtacgccctccacagcgtcgtcgctaacgaggatgccgcccaagcaatcgctaagccggacgccgcccatggcatcgctaacgaggtcgccgcccacagcatcgcgaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatcgcgaacgaggacgccgcccagggcatcgcacacgaggacgccgtccagggcatcgctaacgaggacgccgtccacagcgtcgctaaagaggtcgccgcccatggcgtcgctaacgaggatgccgcccacgcgatcgctaagccggacgccgcccgcggcatcgctaacgaggttgccgcccagggcatcgctaccgaggatgtcgccgacggcatcgctaacgaggacgccgcccacggcgtcgctaacgaggtcgccgcccacggcatctctaaggaggacgccgtccagggcatcgcgaacgaggacgccgcccagggcatcgctaaggaggaccccatccagggcgtcgctaacgaggttgaagtccagggcgtcgcacacgaggacgccgtccagggcatcgctaacgaggacgccgcccacggcatcgccaacgaggacgctgcccagggcatcgcgaacgaggacgccgcccaggacatcgcaaacgaggacgccgcccagggcatcgctaaggaggaccccgtccagggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcgctaacgaggtcgccgcccacggcatcgcgaacgaggacgccgcccagggcatcgcgaacgaggacgccgcccagggcattgcacacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggtcgccgcccagggcatcgctaccgaggatgtcgccgacggcatcgctaacgaggacgccgcccacggcgtcgctaacgaggatgccgcccaagcgatcgctaagccggacgccgcccatggcatcgctaatgaggtcgccgcccagggcatcgctaacgaggtcgccgtccacagcatcgctatcgaggacaccacaccgtccagggcgtggctaacgaagtcgctgcccagggcattgctaccgaggatgtcgccgacggcatcgctgaggacgccgtccagggcatcactaacgaggaggccgcccaggccatcgctaagcaggacgccgcccacggcatcactaacgaggacgccgcccagggcgtcactaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgtccacggcgtcgctaacgaggacgccgtccagggcgtcgctaacgaggtcgaagtccagggcatcgcacacaaggacgccatccagggcatcgctaacgaggacgccgcccagggcgtcgctaacgaggacgccgcccagggcgtcgctaacgaggtcgccgcccacggcgtcgctaacgaggatgccgcccacggcgtcgctaacgaggtcgccgcccagggcgtcgctaacgaggacgccgcccagggcgtcgctaacgaggtcgccgtccacggcgtcgctaacgaggacgccgcccggcacatggctaaggaggacgccgcccaggacatcgctaacgaggacgccgcccacggcatcgctaacgaggacgccgtacacggcatcgctaacgaggactccgtatacggcatcgctaatgaggatgccgtatatgacatcgctaatgacaccgtacaaggcacgctaacgaggacactgtacaggacatcgctaatgaggacaccatacaaggcatcggtaatgaggacgctgtatacgacatcgctaacgaggacaccctacaagccgtcgctaacaaggacactgtacacaacatcgctaatgagggcaccatacaagacatcaccaatgagggcgctttatacgacattgctaatgataccgacaaggcacgctaacgcggacactgtacacgacatcgctaatgaggacaccgtataagacatcgctagtaactatcgcaagaacaaaaaaccaaacactgcatattctcactcataggtgggaattgaacaatgagatcacatggacacaggaaggggaatatcacactctggggactgttgtggggtgggggggggagggatagcatcgggagatatacctaatgctagatgacgagttagtgcgtgcagcacaccagcatggcacatgtatacatatgtaactagcctgcacaatgtgcacatgtaccctaaaacttaaagtataataaaaaaaaaaagacattgctagtgagcacactgtatacgacatcgctaatgaggatgctatatatgacatcgctgatgaggacgttgtacacgacatcactaatgaggacaccatacagatggcttgagcccagtagtttgagacaagcctggcaacacagcgagacctcatctctacaaacattttttaaaaatatgccaagcattgtggcgcatgcctgtagtcctggctattcaggaggctgaggtgggaggatcacctgtgcccaggagttcaaggctgcagtgagctatgatcacaccacaatgctccagcctgggcaacaaagcaagactccatctctaaaaataaaattaaattaaaaaaaaagatcttcgatgtaaaagaggtatgctcaaatgcaataaaatcatataagaaggccgggtgtggtggctcatgcctgtaatcccagcactttgggaggctgaggcaggtggatcatgaggtcaagagactgagaccatcctggccaacatcgtgaaacaccgtctctactaaaaatacaaaaaacaatcagctgggcgtggtggcacacacctgtagtcccagctattcaggaggctgaggcaggagaatcgcttgaacctgggaggcggaggttgcagtgagccaagattgtgccactgcactccagcccggcaacagagcgagactccgtcaaaaaaaagaaaaaaagaaaaccatacaagaagcccctacgaatctgggtgaatcagcaaaggcttcacaggataggaaaaggccatgagtatgaaaacatgagtggggggttggcctagatggtaaacgaggagaggacaatacggccaggaagtgcatgtgcacagcagacgggagatggagggcacggctgattggcagctacctgtactttaatattcctggagtgtgacgtgtgaggcaaacatggggtggtggggtgagtgctggagatgaggcagacagtgagccatcagcatgttagtaacaggggaatccatgggcgtttcatgcagctccaaggaccctatgtgagctcatcagactccaattacccaaatctgtttcttaccagtggtagttaggatttccgtaggtacactggatgtcttcccaggacacctggaagccagaaacaaatggggtcaagcagccagctgacacaagcacccacagaggacaggacactataatgtgcccctcatcctccagacaagcccacccctagcaactcccaagagcctggagcaacagcagcaggatgtcttgtgcagtgaagtatgtttagcgcccttgtccctgtgtttaaacttggtcatgcttttcccagaggcctaacttacatatttctaactctccttgctctctagacatttcccacaaagcaggaagctgcagagcatgagcctagagcaccaaaaacttagaagtgaagtgaattgaacccttgcagaggtgcaaaccacatggggacttcagaccgaaaaaggcttgaaccctcatcaaaggccccacacccagacagcaggatcacagtgtgtcttgatctcagagacccaggcagccctgagcccagcatttgctagaggtggccaatccagggcaggaggcaattgtggatgatgtttcttaccaagcaaatattggagtcattgaagcagaaccattttccatccacagcattccggatgtagacacagtaatgaccggagtctgccattcccacgtgcgcaatcacagcaaaaagctcatactgccctccagactggaaagagacaggcacgagacagttcacccaccaccacaaacacgactgcctcacacatttatacctgtccacccgaggcccgactctgggactttagaatattagaaaacagtcctgacccacggccagtgggcaccctccaggaggggctttcctgagtgtggatcctgaactgtgaaggctcagcagcttggcagggcagagcacacaagagatggaaggcatgaggtcatgagagaggcccccaaagccaaggcaagattagaactttcccctgggaggggtggggatcatcagaacacagttctgcttctccacaagcccaggaatgaccctaacctgagccaccgtacccagccaaaaaagtcttttgtagggggaggggagacagagggcaagggcggcacacgcaaagctgagtcacccacagtggaggctgaaattatccctatttccatttgcagactttgtgcagaactttacaaaatgcagggcaatatctgtatctaaatattagtttacaagaaataaaagggttatagatgatgttaaaagatatcaaccagccagtgctggcatatgaaaaaaatattcaaccaaatcaactgcaaggaaaagaaaaggagcggaaatctaaaaggaacttaagaaaagaaagaaacttaaccaaatgcaagtgtaggcgttgtttggatctagagtcaaacaaaccacatagattacacaacagtcaggaagtctgaacgttaaccagatatttgatgctattaaggaattgcaagatggagatgattatcttttaagtgcttattctttagtgatacataatgaagtgtttataaatgaaatagtatgatgtctgggatttgcttcaaaaaaatccagtacagggttgggtgaaacaagagggtgggttataggaaaagcaagacctgccatgcgttttggtaactgttacagccaaggattcactgtctaactcttccttcactacacactttggtatctatttgtaatgttccataacaaagtcttttttgttgttgttgcaaagatggagtcttgctttgttgtccagctgggctcgactcctggactccagcaatcctcttggccccgcaaagagctgggattacaggtgtgacccactgcatccagccaaaaaagtcttttttaagtgaaaaacaattttaaatgtacttcatcgggtagaatctgcaggtagaaataaaaagaactagaaggaaagaaaaagagaatcctatgaaatgtatacggcctaagtagggaaagaaatcatgttataataggagctattgtaacgtattatcaggtcttaattttctaaatgtcatggttctagagcataaatagccaaacagaccaataaaacagaagagacactccaaaaatagacccgtacatatagaaatacaaaatttgttatgtagcatttcaaatctatggaaaaaaagatatttgggtcctttttttttttttttttttttttttttaagtttttcttgttttgtttttagagacggggtcttgcgctgtcacccaggctggagtacaatgatagatcatagctcactgcagcctcaaactcctgggctcaagtgatcctccaactcagcctcccaagtagctgggactaaaggtttgtgctaccacacccagctaattttttttttttttttgagagacgggggtctcattatgttgctgaagctggtctcgaactcctgggctcaagcaatcctcctgcctcagccttttgaggtgtgggatcacaggcatgagccacatcacctggccttgtgtctctttttttctcagaatctcttgataagttattatctcaggacaagtgaattaaactttactctgattaaatgtggtccagtcaactggctactttatgattatcctcaaagtgggcacaggccatctgaggaagaaagtttggttggtactatgaacccacaatgacatgtttgcctatgcatttctatgtattccacattatttccaaagaagcctactgaattctggattctgtccctcagtgctgtgaggcatatgaacacaaatccaatatttagaaagaagaaaggcttttgaggctggggacagtctctgaggaacaggtggctcctagcagactgggggtgaaggaagggaaaacagaaaggacatggcatctggggagaggcaggatggcaaggaggtcgggatcatcccacctgctcctcagcatcacaagactctcgcttcattggaaggatctggctgaaatccaagctctgggggaagtacagggagtggcagatctttctcgtctgtgaattcctgatggagaatcgcatgaggtggattgtcagggtctggggcaaatgggtcagcttcaagacctgaaaaatcaaaatcactctggagatgaagtccacttggaatgagagagtcagagaaatgtcagggctagcaacgcgttcttcccaaaaagaggggagcagggcgacatcatggagttcaaggctcctgttcactgaatctgctgagctcctctgagaataatgcaaaacttggctattctaccaccatgtggccccccacaagaggcacaagggcacagggctctgcacaggtaccaggacccagggagccaccacgtctgctccagggagctggtctcgccccgagggaaatgccctgcccgctgctctcaggccccctcctgcagtccctctcagtgatgcgacatgagaagccacatccacggctccagatatcagaaccacagcgtcccagatactagccagacccagattccctttctcacccatcatgggatgtcctcggggcctctgatgattctatcaggaaatccacggggggcaaccccagactagtgaaggacagatgacccctgaacagcacaggtttggactgtatgggtccgcttatacacaaattgttgtaaataaatacagtctgccctcccccataggcacgagttccacatctgcaaccaaatgctcatcaaaaataaagtatcccagatgcacaaccgcatagatgagggactgacttttcctatacgtgggttccacagggccgactgggtgtgacttgagtgtgtgtggattttggtaaaagcaggggtcctggaacaaatcccccatatgcaccgagggacagctgagtctgatttagggaatgagtacctgtttcccacgggtcttcttcccacagttctcacagaagcatttgcttttgcttgataactccctgggctggaagaagcagtgcagggcgtcctcctgtcccacccaagagaacagggaaaaagcagcgttggtatttcccacctagaatactatattcgtctgttctcacactgctgtgagacaatagctgagactgggtaatttataagaaaagaagtttgattggcccatggttctgcaggccgaccggaagcatggcagcatctgcttctagggaggccgcaggaagctcccaatcatggcggaaggccaagcaggagcaggcgtcttacctgggaggagcaggtgcaagagaccaagtggggagctggagtgcaggagcgcgatctcagctcaccgcaacctccacctcccgggttcaagcgattctcctgcctcagcctcctaagtagctgggactacaggctgcaccaccacgcccagctaattttttatgtttttagtagagacagggttttaccatgttggccaggctggtctcaaattcctgacctcaggtgatccacccacctcagcctcccaaagtgctgggattatgggcgtgagttaccacacccagcctggctccacacttttaaacaaccagatctcatgagaactcactgtcacaaagacagtaccacgggggatggtgccaaaccattcacgagaaacactcccccatgatccaatctccttccaccaggctttacctccaacactggggattacaattgaacaggagatttttgggcagggtcacagacccaaactgtatcaggtacagcctccccacactttgcagctgagggtttcagcttttcttctggttctcctcatatcccccttaatgcctggcctggtgtggtccacttggcaggatctcaaagggcacctactgactggaggaacaaaacaggagggggctcctattaagggagcagtatgagggaagtggaggtaggagggaaaaacatttttgccaaaacaaaggagaaattggccagcgccgtgaaaatgaaataagtgactttccagaagccagagatagatcaaagaggcaagggggaattggccacactgtgctgtgtggtgtgatggtttgagggtttgtcctccccaaaacccaggttgaaactgaatccccagtgtggctgtatggaaaggtggggactttgagagataattggggagggcaaggtgtctcatgcctgtaatcccaaggaggctgaggcagggggatcacttgaagtcaggagtttcagatcagcctggccaacatggtgaaaccccatctctactaaaaatacagaaattagccgggcatggtggtgggcacctgtaatctcagctacttgggaggctgaggcaggagaatcgcttaacaccggaggcggaggttgcagtgagctgagattgtgccactgcacttcagtctgggtgacagaggaagaatctgtctccaaaataaaaggtaggggggttattgcgtcatgagggcacagccctcataaatgaattaatccactcatggattaatgggttaatcggttatcctgggagtgggactggtggcttcatatgaagaggaagagagacttgagccggcacattagcatgctcagccccctcgccatgtgatgccctgcactgcctcgcctcaggactctgagagtccccaccagcaagcaggtcctcaccaggtgcagcccctcaaccttgacttcccagcctccagaactgtaagaaataaattacctagtctcagatattgagttataacaacagaaaatggactaacacatacaggtgcagcaaataccaagagaatccccttaccagtgtcttcaggggctttgagtccacatcaaaaaaagaaagtcggagggtgagcatgctgctgtttctgctactctccatggcacagtcaaggcaaatcaaggagtccttcatccggatcatatacagggcctgcagtctctccacctgcaagagggagagcggagaggtgagatgggaacaccaccataagccaggtcaggccaactgccagaaggtggagccaagagacagaagctcctcacaaaggtgcaaaataataccagtaacaatattatgaaactgtgataagtgttttatgtggattaactcttttttttttttttttgagacagagtctcgctctgtcacccaggctggagtgcagtggcgcgatctcggctcactgcaagctccacttcccgggttcacgccattctcccacctcagcctcccgagtagctgggactacaggcgcccgccaccacgcccggctaattttttggtatttttagtagagacagggtttcaccgtgttagccaggatggtctcgatctcctgacctcgtgatctgcctgcctcagcctcccaaagtgctgggattacaggggattaactcttttattcctctacacactacgggaacaacagctgaatgaatgaaatgagcagcatcttaagcttccgagtgctctggttctaggttcttaccaagtgcacatcagcgatctggtccttaatcaggttccagagtttgaggtacagttgggcagcatcatgttggacaaacactggccacagagaaaaggaacagccaattagtgaggtcttcagagtcacttctcatgccctggtacttagacacacatgaacactgatcactttgtctcttcctagccctccaccccactgcaaggctaagtcggcacgacagaagaagtgatcaataaacaaacagtaagtttggtattgatttttgagaacgcctcttaatacttaagctccagtgccagatgtagtggctcatgcctataatcttaacacttcgggaggccaaggtgggaggatcgcttgaactcaggagtttgagaccagcctgggcaacatagcaagactccgtctcgataaaaaatttaaaaaagtacttgagagtagcggtgcacgcctgtagtcagagctacttgggaggctgaagcaggaggatcactggagcccaggatgttgaggctacagtgagctgtgatgtcaccactgcactcagcctggggaatgagatgtccacagggactttgaaaagcactgatacattcctgaggatctagaaggccaggcgcatgcccaagtaagacctgagagggctccgatccctcccctctggctgaccacaaggccacatgcaagaaagcaatgaaggcgaatacagaatcatgaactgcccagaaacgataaaacagcaacaacaacaaaccctgctgtggggatctctgatgtccagtgttgccaccttacattatctaaaatgttcattttccaacaaaagagacaagacctacaatgaaacagaaaagcatggccacccaggaaaacagcaatcgtagaaccttccactgagaagccctagatgttggcgttactaaacaaagactttagccgttataatatgttcaaagaactaaagaaaaccatgtcaaaagatgtaaaagaaagtgtgaaaatgctgcctcaccaaataaaaagtatcaataaagaaaaaactataaaagaagaaccaagcagaaattcttgagttgaggagaaccataactgaaatgaaaaatgtactagaggaggtcaatagcagattagagctggcaaaagaaagaatccataaacctggagctaggttggttgaggttctccagactgaggacggaaggaaagctgaacacagtacctatgcagcgaaaagctgaggagctgctcactgcgtgtagagctcaactaactctgatacaaaaaaaaatgtgatacaaaaggttttatacacaaacgtgaacttattctgaagccagcctggggcaaggagcaagacacatcctgccttttaatgtgccatttctcctttggaggagagaggggcattttcataaggtgtgttgtgggggtggggggagtgagcaatggcggttttctaccgggcagttatcaagttcccagcagctgagttggcgcctttccgggcagaaaagtggccgagtgggcatgctttctccatgccttcctagtgggtgaaagacaaacccctagagggtggaagtttcgaagccaccccctggcagggagagttccctggtgggtatgctttgggctgcaaatctactgccaagtctcaggaaagatcagctggaagatcttgccctgttctcaatcaaacctccatcagcctacctccatttacagattcttccttttgcccagcagggaatgtctggagaggggtaggcgaaaggtgatatttgcatttctaaagggctaacaggaaacaggaaacacggccgcggtgaggggtgagggatgggaagaggagaagtgaaaagaaagtaataagaaaactaatataactatctcttagaaaatgggagtactcagttacacccagatgggttcactagtgaacgatgggttctaccaaacatttatgggaaaaattataccaattccctacaacctcttccagaggacaaaagcagagagaacacttcctaactcattctctgaggccagcattatcctaacaccaaaaccagacagacattgtaagaaaaaaacctaaaaaccagtatctcccgtgaacataaatgcaaaattcctcaacaaaatattagtgaatcaaattcaactatgtataaaaagaatcacagagggtgacacaagcgagatggtagagaaggaggctcctggtgctccccttctcccatggacacacggtaaaactctcatctacacacagatcaactccctctgaaagaaacccagaaaccagctgagagaggcctgcacagggggcaatggggagaacacccacatcgcaaccggttggaaaagctgagacacactcgaaccacaagccccaccccagacacagtaccttactgtgaggaaggaatccctactcccagctttctcctggagaggggagggtttggaccacacataggcagccccagcttttgcagttcccactcaagggcttggctgctgggtcacctagctctgggagcagacatgggttagcagttatgaatcctctgcgaccacagaggacaaagaggcagttttaaacgggcacgtgagcacttccagcagctgtgctcagcacagagcaaacaggcagaaatgccaggctcccagttcctccctggaaggatatgtctgcgggctctcctagctgttgcccgagggatgggcttctattaataactggcctgcacctggagccaatgaggcaggtaaacaatagatttccaggagtctggacaggcctgtgggcaagtcccatgccttctcccaccccctgctgtatggtaaaatcaggtctctaacttcacacattgagtacacatttacccctctcaaatgaaggtctagctcctcaaccaccgagctttgggagctgacaaggctctgtatttgtaagtcccacaggggcacagagaccaaagaacatccccccaggcccagtgcagcgtgaacaggcaaaaaggcccggctcctactttctccctagaaggagtttgtctgcacagtgcagctgctgccctggggtttctatgcatctgggagctgacagagcaggaaaccagtgctcctctgagaccctgaacaggcaggtgagcacctccacagctgctcccactggtttgctcaacagatagcgtcaagcttccaactaacctgtccgtctctaagcagagaacagccagcatttgctaggcccctgggggtgacaaagagtaaaacaatgcatgaaggagtgtgcagtttaaacttgagtgcaggcacttgccacagatcctctctccagcattttgcagagcgagtggcagataaactcatgctcccagcttttccctgaggatagaataaactggaacacacatttaatgccccaacgtctccagctgcacctcaaggggctggtttctatctcccctgtctggggcactgacaggacatgacacattctaatctcctgagggccgctaagaacatagatgacagtttggacaacacaaaaggtcaagaggtgctccgagtgtctggcagggctaattggtaagttcgtctcttatacaaggcccgtgggacaagactgggagaggtatttttcttttttttttttgagacggagtctcgctctgtggcccaggctggagtgcagtggttcgatctcggctcactgcaaactccacctcccaggttcacgccattctcctgcctcagcctcccaagtagctgggactacaggcacccgccaccacgcccagctaattttttgtatttttagtagagacagggtttcaccgtgttagccaggatggtctccatctcctgacctcatgatctacccgcctcagcctcccaaagtgctgggattacaggtgtgagccatgatgcccagcctgggagaggtatttttcttaactaaagtacagaaaataacagagaatcaagaacaatgaagaaacagagaaatctgttccaagcaaaagaacaagataaatctccagaaaatgcccccggtgaaatgaagataagtgacttaccttacagacaattcaaaataatgatcatgaagatgcttaccatgtctaggacagcaatgcatgaacaaagtaagaatttcagcaaagagacagaaaaaagttcaaaagaaataatagagctgaagaatacaataactgaaataagagctcaaaagagaagctcaacagactaaatcaagcagaagaaaggattagcaaactagaagataggtcactggaaatcattcagaggagcaaaaatgaaaaagaatgaaaaagagtgaagatatcttaagagagttaggggacatcaagccgaccaaaataggcattatcagagtcccagaaggaggagagtgagaagagatggaaagcttatccaaagaaataacagtcacgagttgcagatcaacatttcagtcaatggcagaccgcatgagcacagtggccatagcatgcagcctagctgtgtagtaggctgtcccatctaagtttgtgtaagtgcactccatgatgtccacacaatgacaaattcaccttctgatgcattttcagaacgtatccctgttggtaagcaacgcatacctataatgactgaaaacttcccaacccagggaaggaaatacaaatccacatccaggaagcccaaaggacaccaataagactgatctaaagcaacccacatcaagacacatcataatcaatttcaaaagttaaagacaaagaattctgaaagcagcaagagaaaagcaatgtattatacacaagggaaaacccgtaagtgtaggatttcttctgggggtgatgaaaatgttatgaaattagattgtgatgatggaggcacaactctgtgaatacactacaaacctttgaattgtatgtttttaaatggatgaattttacagtatgtgatgcacatcccaatatagctatctaaaaaaaaaacctgacctatttgtgaattattttgtagaacatgttttctcttttttattcctttattctgttttcctgcagttccctaactgtggtggaataagcttggaggagatgccttcacctactctactgagaggcagagaaaggttaggtatggaagtaaaatgtccataaataatatcaattctgcacctccaaagatgtgtgcctcttacacaaatgtctctataatctgaggggtccaggctacctaacttgcttcttgttgcttcactgcccattagttcctctcttcactctctaagcttcccatcccctttggatcagcagccaggaacccagtgggagggtatcttacggggcacgttgtacttctgcaggcagtaggccagctccaggggccacactgctttctgccggctgtcctgcatcttctccagcagcagaagcatctggaaagggacgcttctcctctgctcgtcagctcccctgggcaccgtgatcctgccacacaagaacagccagaaacctccttacatgtagttctcaaagctaggtgcacactggaatcacctgggagaaattttaaatcttcatatccaggccactcccatacaaattaaaccagaattctgggtccggggggcggggcgcgggcagttatcagaatttttcagttcctcagattatttcaatgtgtggtcaaggttgagaagcaccatgtgagtgaatctgctctacaggggaccctctagagagggggatcagcatgactgctgccttggcccctctgcaccctgcccagcaatcgtgctagagcagacggcagatgcacgaggtcctggctccacatctcgggcaagcagcaaaatgtccagcctaaagctctccagactgcagaggcacatgctgggttaggtcctgggaagaaaggcaacatgaaaggctgtccgtgtggtttggcaatgattcatttaatcacaggcatttttcggatgggaaaaaggagagagcacagggcagaaaaggagtgatagagagagacagagggagagagtgcattgtgtgagtgttggtggaaggaggggtgtgtactccccactgacttactccttctccgactttggtctagtcccaactctgtcttttaaccaagtcagtggctgtcaatcctggctgcatttaaaatcacccaaagagggcttttaaaaagtaccaatacctggccgggcccagtggctcatgcctgtaatcacagaactttgggaagctgaggcgggcagatcacctgaggtcaggagattgagaccagcctggccaacatggtgaaaactcgtatctactaaacatacaaaaattatccaggtgtggtggcgggcgcctgtaatcccagctacttgagaggctgaggcaggagaatcccttgaacctgggaggcggaggttccactgagccgagattgcaccatccctctccagcctggggacagagtgaggctttagctcaaaaaaaaaaaaaaaaaagtaccaatacctgggccgcaccccagaccaacctaagaagttttagaaataatgtgtaggccagaatatgcagaagccgatctttcctctgccagcttttgagagaagatctcaaaaagtccaagtcactgtgaataactgaatatattaaaaatgaaataatacaggccgggtgcagtggctcacgcctgtaattccagcactttgggaggctgaggtgggtggatcacgaggtcaggagatcaagaccatcctggctaacacggtgaaaccccgtctctactaaaaatacaaaaaaaattagccaggcatggtggcgggctagtcccagctactcgggaggctgaagcaggagaatcgcttgaacccggggggcagagcttgcagtgagccaagatcgcgccactgccctccagcctgggcaacagagcaagactccatctcaaaaaaaaagaaaaagaaataatacaaacgcttatcagcctgaagaacagtcttacctcttcaatatcctggcgaagtccacattcattacaaacacctgaatcaaggagttaaggcagcaggtctgtccaatgttgtgtaaaccaaccaggcctataaggggaagagaaaaaaatgctgagggcaaggcctaggtaaagaagttgacaaggctgggcatggtggctcacgcctgcaattccagtactttgggaggccgaggtgggcggatcacctgaggtcgggagttcgagaccagcctggccaacatggtaaaacgtgtctctacaaaaaaatccaaaaatcagccgggtgcggtggctcacgcctgtaatcccagcactttgggaggccaaggcaggtggatcacctgaggtcgggagttcgagaccagcctgatcaacatggtgaaaccccgtctctactaaaaaatacaaaactagctgggcatggtggcacatgcctgtaatcccagctactcgggaggctgaggtaggagaatcatttgaaaccaggaggtgaaggttgtggtgagccgagatcacaccattgcactcctttctgggcaacaatagtgaaactccatcaaaaaaaaaaagaagaagagaacttacagcagggtgtggcgtttcacacctgtaatcctagcactttgaaaggccaaggtgggcagatcacctgaggtcaggagttcaagaccagcctgggcaacagggcaaaaccctgtctctactaaaaatacaaaagctagccaggcatggtggcaggtgtctataatcccagcttcttgggaggctaaggcagaagaatcattggacctaatttattgatttttttgaacttggaatatggtgtcatgacaaaatcatgccactgcactcaatcctggatgacagagcaagactctgtctcaaaaaaaaaaaggttactttttatttcctgaaaagcttgacttcctgacaatgaaagtcctaaggagcgagtggcagaagacagctggcagctggcagtcattggtggggcaaaggcagagataccactgctgactctactgggcctcgggcctcagcgctcatgggaagggaccctctttcaagcttttggaggggtaagggagggccaggtaacagtgcctacatcttaggcaccgaaaacaactggagctgcttcatgcagtcaagaatcccctgaagaaggaaggcagttacctccctattctccagatctcttcagctggcctggctctcatcctttccaagacctggctgtttgctttgcatttagttatatgagctaattcatatgcttctaataaatgcctttcatccttctccaaagttagccctagagtatattgctgttgtttacaatcaaaaagccccagaggtgtactctccaattctcttaataacctcatttttctgtcattacccctgttttagtacaagtagctgagcttcagagaagttaaaagatgtgcccaaggtcgcacagctaatgagtgtcacagtcagaatctgaacccaagtctgtctgatgtggggtcatgacaagagcatgggttttcttgggagaaaaaaatgacttcaaatccccacttcccgcataaaaatgcacaatgggtgtagcaatgccgaagccacagagctattgaggatggatggaggtgacgcataggaaagcacatggcctagggtatgtattcccaacactttgggaggccgaggtgggcagatcacctgaggccgggagttcaagaccaacctgaccaacatggagaaaccctgtctctactaaaaatacaagataagctgagtgtggtggtgcatgcctgtaatcccaactacttgggaggctgaggcaggagaatagcttgaacccaggaggcagaggttgtggtgaaccaagatcatgccattgcagtccagactgggtgaaaagaacaaaactccatctcaaaaaaaaaaaaaaaagaattaagaaaaaatatttgaacacttctttttatccctaatttattcatgtttttgaacttggaataggaacactactgccaacaaaagtaattagagaatatagatgttaaatctattctctaaatgaattattgcttattttaaaattgcatattaattaattacaggaaatttggaaagtaagagacatatgaagaaaaaaaggtaaaaatgatttgtaatccctctgagagttaccctttaatgccatttttggtatatttcctctcagttctttccccctccaccaccagtatgtgtgagtagtttatgttttataaagctgggttcatacaatatgatttcttggctggtgtggtggctcatgcctgtaattctagcactttgggaggctgaggcaggcatattgcttgagcccaggagttccagaccagcctaggcaacacagtgagaccccatctttacaaaaagtaaaaaattaggtggtggatatggtggcacttgcctgtagtcccagctacttgggaggctgagaccagaggatcacttgaacggaggaggagtctgcagtgagcctagattgtgccactgcactccagcctgggtgacagagtgagaccctgtctcaaaaaacccaaaaaagatttctctataatttctttttttattcagtaaaatattgtagttttctctatcttgattaaacagtctaaaatggttttaatgtcaccatagtattccattttataaatttgtcaaaatttatttaacccttattgttacatttccattttttaaaatagtgctgcagctgttgatttgaaaagatacttttttcaggtagttgacaaccaaaatatccccttgatgggttccagcataccccatgcctcagtatcacacagtatacctttgtaactaacctgcatggtacccccgattctaaaataaaagttgaaaaaaaatcatctagtgttttaaaacaaattatgtattatttttgggccaagcgtggtggctcacacctgtaatcccagttctttcagaggttgaggtgggaggatcacacaagaggatccactgagaccaggagtttgagaccagcctgggcaacatagtgagacccccatctctacagtaattaaaaaaaaaattagctgggcatgatggcatgcacttgcagtcccagctacttaggaggctgaggtgagaggattgcttgagcccagaagtttgaggttacagggagctatgatgatgccactgcactccagcctgggtgacagagcgagactctgtctcaaaaaaatatactattttaaatttataaatgacaattgaattacatttatatagtacaatgtgatgtgtgatgtatgtatactgttaaagagaaaagcctttgactaaatttgacagagtttagttgaacagaaaaaagattcatgaaccaggtagcactgagaaccaaaagtggttcagagatctctgctccacaggtgggcagggaatatttatagccagaaaacgtaagtttcattgagaaatagcctgttggttacagctctgcagttgccttgtttgaacatgtttttggcagcttgcagcctgtgaagggctgagagctcagctgctgtgattggctgagactgggctacttattccaagggcatattctcaggttaggttgcagtttgttttgtttacctatgtgaacccccaatagctgagacaggtctcagttaatttagaaggtttatttgccaaggttggtgacatgcacccataacacagcctcaggaggtcctgacatgtgcccaaggtggtcagagcacagtttggttttatacattttaaggagacatgagacatcaatcaacatatgtaagatgaacattggttcggtccagaaaggcaggacagctcgaagcaaaggtgggacaactcgaggtggggagggggcttccaagtcttagatagataagagacaaatggttgcattcttttgagtttctgatgagcctctccaaaggaggcaatcagatatgcatttatctcagtgagcagaggggagactttcaatagaatgggaggcaggtttgcccaaagcagttcccagcttgacttttccctttagcttcttggggccccaagatttattgtcctttcacatctattaagttagattacagtgtgctatatatggaggcagctttattttattttaattaattaattaatttatttgttggtgatgttgatttctcttgttttaaaatcaacattataggctgggcatggtggctcatatctgtaatccctgcactttgggaggccgaggcgggtggatcacttgaggtcagaagttcaagaccagcatggccaacttggcaaaactctgtgcctactaaaatatatgaagattagctggtcacggtgatgcacacctgaaattccagctactcaggaagctgaggcaggagaatcacttgaacccaggaggcagaggttgcagtgagctgagattgcacgattgcactccagcctgggtgatagagtgagactccaactcaaaaataaataaataaataaattaattaattaaataaaatcaactttacggagaaaaatttacattcaagaaaatacgcccattttaagtgtccagctggatgaattttcagaaatgtgtgtaccctcatgaccacttcctcaatcatgatacagaacattcccataacctggaaatccctgtggccctttgctggcagtttccccacccagccccaggcaacccctgatctgccctctgtcactgtagactagttttgccttttctagaatctcatatagagggagtcatgcagtatgtactctcttgtagctaatgtttttgaggttccttggtgttactgcattgttttctattgctgagtagtattccgttctactcagtaccataatttgctcatctactcttctgtggctggactttccagtttggcgctaatatgaattgtggaggcagttttagaccaaatttaacttaacaatacaatatgaaaagattaagtcaagctaatgaacatacctgttacctcacttacttggcattcttttaagttgatgcactagaaattttctctcttagaccgggcacagtggctcacacctgtaatcccagcactttgggaggccgaggcggggggatcatgagatcaggagatcgacaccatcctggctaacacagtgagaccccgcctctactaaaaatacaaaaaattagctgggcgtggtggcaggcgcctgtagtcccagctacttgggaggctgaggcaggagaatggcatgaacccaggaggcagagcttgcagtgagccgagatcacaccactgcactccagcctgaaagacagagactccgtctcaaaaaaaaaaaaatttccttagttattttgaaatattcattattattgactatagtctcctgctgtgcaatagacctcaaaacttttttctcctgcttggctgaaactttgtaccttttgaagaggaagtctccattcccttgttctgccacctcgccagctctggtaaccattattcttctactgaatgaattcaactttttttttttttttttgagatgtctcactctgtcacccaggctggagtgcagtggcacaatctcagctcactgcaacctccgtctcccaggtttaagcgattctcctgcctcagcctcccaagtagctgggattacaggcgcctgccaccatgcccagctaatgtttgtatttttagtagagacagggtttcaccatgttcgccaggctggtctcaaactgctgacctcaagtgatccacctgcctcagcttcccaaaatgctgggattaccagcatgagccagggcgcctggcccaaattcaactttttttttttttttatgagtgagcagcagcaagatttattgcgaagagcgaaagaacaaagctcccacagtgtggaaggggacccgagtgggtagctcccaaattcaacttttaaaagattccacgggcatgtgagattatgtggtatttgtctttctgtggtatttgtatttcacttagcagtatgtcctctagatttattcgtgtcattcccaatgacagagttttgttcttttttatttttttggagatggagtttcattcttgttgcccaggctagagtgtaatggcatgatctcggctcaccacaacctccacctcccgggttcaagtgattctcctgcttcagcctcccaagtagctggaattacaggaatgtgccaccacacctggctaattttgtatttttttttaatagagatggggcttcaccatgttggtcaggctggtcttgaactgccgacctcaggtgatctgcccacctgggcctcccaaagtgctgggattacaggcatgagccactgctcccggctgagttttgttctttttaaggctgaatagtacttcgttgtatgcgtgcaccgccttttctgtacgcattcatcttaggctgattgacttaggcagattccacatcttggctactgtaaatggggccgcagtgaacatgggagtgcagacatccctgaacacactgatttcaattcccttggatatattcccagaagtgggattgctggctcacatgatagttctatgtttagtgttttgaggaacctccatgccattttccatcgcggctgtactacacaccggcagtatactaggattcccctttctccacatcctggccaaaacttaccttccatctttttcataaaacttgttctgatgagagggagatgttatgtcacggtggttttaatttgcattttcctaaagatttaggttgccactggtcagctccaggccccagagcttcttcaactgaagaagtacttgctgtctatagtaagcatctcaaactttaacgtgcatgtggatcacctgggaatcttgtcaaatgcagcttccaggtaagtgggtctgcagtggggcctgatattttgccttttgaacaaactcccagataatactgatgttactggtcccaggacctgcctttgaggtagcattttttcatgaacctattggctgtttgtatgtctacttttgaaaaatgtgtttggttcctttattcattcttacattggcttattggttcttttgctgttgagttgattgagttcctcatatattttggatattagccccttttctaatgtatggttagcagatattttttctcacgacgtgggttatctctttgttacttgttccttttgctgtgcagaagcttttcagtttgatgccatcctgtttctatttttgcttttattgcctgtgcttttggggacatacccaaaaaatcattgcccagatcagtgtcatggagcttttcctctgtgttttcttatagtaattttacagtttccggcataatgttaaagtctttgatccattttgggttgattttggggcatggtgtaagataagggtctaattttattttctgcatatgaatagccacttttcccagcaccatttattgaatagagtgttcttaccccttggcgtgttctttgtgcctttgtcaaaagtcaatagacagtcagctgggcacggtggctcacgcctgtaatcccgcactttgggaggccaaggcaggtggatcacctgaggtcaggagttcaagaccagcctggccaacatggtgaaaccccatctctaataaaaatacaaaaaattagccgggtgtggtggcaggcacctgtaatctcagctactcgggaggctaaggcaggacaatcgcatgaacccaggaggcagaggttgtagtgagccgagatcactccactgcactccgtccagcctgggcaacattccttctgtgttctgggatatatattcttgagggtattcccatctgtggatagttgccagttagatttctgtggtggggaagtggagctagagtattcttttcctttttttttgagacagcatctcactctgtcatccacgctgcagtgcagtggcattaacatggcttcattgatctcttgagctcaagtgatcctcccacctgagtctcctgaaaagctagggctacaggcatgcatcagcatgcccggctaatttttaattgttttgtagacatgggttcttgctgtgttgcctaggttggtctcgaactcctggactcaagcagtcctcctgccttggcctcccaaagtgctgggattacaggcgtgagccactgctcctggtctgtttcttttgtttagtatttttgtttgctttgtttcatgagctgctattttgactacagttttaatatttttagcaattttttggatatgcagaaatttaattcttattcatcaaatatattttagtattttgtgtgttttttagatttccttttttaggagtctttccaaccataaactgccaaatagaaatacacacacacacatacacagaggctatgaatagacaactaattgaaacagaaaaaaattgattaattaaagcacctatgggatttttctccagccaaattagcatttttatttaaaaaaatcttttagtgttatttagcctacataggaagaggcttacttatgtagttgataagagtgtgaattgatcaactttttggaaaataatctgccagtataattaaaattataattaaaatgtatcataggtcagttacaccactttgagaatcctatactacagaaaagaagaaatataaaacaaaaacatcagtgggatccatgtatattgatgattattgtagtcatcagtggtgggaatttttaaaaacaaccttaatatccatctaatagggaataaagaaatcagaacttatctacaatgcgcattactacacagaaattcaaatgatacatttgatctacattagctggaattagtaatgtccatgtactctaatgggagaaagaaaattactaaataatgtaagatttgagcacgttctttaaacaaaacaaatcaataaagccctaaaaggacatactattgaaagcaagtcacaaaatccagaaatggcagggaaaatgttcaacaatttgactatgtaaaaatgaaagtttcttcaaaacaaagataatataaacaaaataaaagttatgatacagaccttaagaaacaaacttgctaattatatggaattaataaatgtgcagaatatataaagaatatcattacatgaattagaaaactagtaaatcataatgaaattctcagcgagaaatacaattggccagtaaacatatgcaaaaatgcacaatctctctaataagtggagaaatccaaattaaaaatggaaatatttcttaatcataaaattggccaaggttagcattggtcatttcctctgtaactaagggtgtgtggaaataggaactctcatatactgatggtgggagtataatatcattaaatttttttgaaacacagatttttaattttttatcaaaatatggccaggtgcagtggctcacgcctgcaatcccagcactgtgggaggccaaggcaggcagatcatgaggtcaggagatcgagaccatcctggctaacatggtgaaaccccgtgttatttgtaaaaatacaaaaacaaaattagctgggtgtggtggtgggcacctgtagtcccagctacttgagaggctaaggcaggagaatggcatgaacctgggaggctgagcttgcagtgagccaagatcacaccactgcactccagcctgggcaacagaacgagactctgtctcaaaaaaataataataatattaaaaatttatactttgcctcagtattttatttttagaaatcaatcataaaagaaaaaacccacctaactaaggtaccaaaaagatgaatatacaggtatgcccaggatagtgtaggtaacggtaacaaataactgaatccaacataaaaattccacagtgaaaaagtgaccaaattatggtcagataccctgttgaataatgatgcaactataaataagaatgagagagacctatatgcactcataagcaatgatcaccacattctattttatatggaaaagccagttagggaacaacacacaaagcaggattacgttatgtaaaaacatgggcatgtctatctgtgtgtaagtggatgtagacgactgagtgggctgggagctggcggtgacacatttcattctacagacctaagcagtatttgaatttttataacaatagcatatgtgtttcttatgtgatttactagaaacaatttaatttcttcagttgtaaaaggtgtattttaaacctatataaaggtacatggagatcgtcattcagaataacaaaataaaaagcaatataaagacacaaatagatatagtacaatattaaatactacaatattcaagatgatattaaaattatatatatctacatctatatgcatgtaaggatctcagtaaatgatattgtctaaaattaaactgtggtaatttttgcagacctctgtgaatatattagaaaccattgaattgtgtgtacactgtgtgtgggtgaaatttattgtatttgaattatatctcaaagttctgttaaaaaatgaatggcttgatattctagtgctaagggatggttttatttaaaacataaactaatagtttccagcagagtcccttaaaaatattacagcagggatttccagatcacactcactcccacctttttagaatttttgactattttccaaagtattgaattcaatgaggtgcaggtggaagaaagcgtttacaaagtcagtgggttacgggagagctggtgtgggttgaggcagagtggggagagaggctcctttcaaatggaagcctctggaacccacagacggcaagcgtaaggcagggcaatcttctggagacctaccagagaaaggctttagacccaacactcccattcacaaacatggacaggggcatctcagtgtttccttaacttcactctttctatattgacacaaggaaataattaaaagggggtaattctggtttagtttatttcattaaattatcaacaaacaacttttgaaacaaaaactattaaagtggaactcaataaaattactaggtttaataatctgtatctgtgactcagatacagatcaggcaaaccagctgtggatgaagctcccagctgtggatgatgcccccagacatggatgaagcccccagctgtggatgatgcccccagatgtagatgaagccacaaatgatgcctgtgtggacagacagaatgatggacaggcagatgaatgtgagggttttatgtgaaacaagtccacttggttgttgacaagatgctgttttaaagtttcattttgccatactttgaatagcttttcattagctaaatttagccacatgtaaaatcactaaggcagacacctggagttcccatatgaaaatcaaatgtaaaccagcagtgacctacttcaatgtgatcatcggaagtcagaagttgagctcatttttgatgtttaaagcctgcataatattcactgtgttattattcagtgtattactatttccttcatgatggaaatttggtttgccccaactttctattctatcaaaacactgctacatagaaaatccccatgcacatatttctcctaattgtggaaatattttacataaaagactctagacatgggatgaaattcccaggttattggaattttaaaatagataggtactcccaaattgccgtcttacaaattatatgaattcgtaagcttccaactgttatggagttacccattttgagaaatctgtgctaaaaggacccaaacaatgctgatgacaatgatcaggataataagtacgctgggaagacaacaaaatgatttaaatcttagacaagtcattctaggtgtctccactgtttcagttcttgcattcattcttgtggtatcttttcccttttaccaataaaaaagctccctgacatcacattgtggcagtccccatggtttgccgcagttactgcgggactgaacgaaggaggacgaatgaagaaatgaaaaccaaggaaaaaaggagctgtttaaagaagggtccagggaagaagaagagggctcccagcttctagtgagcaagggcagcagccctgagcttctacagcccttcatatttattgagtagaaagagcagggagcaggaggtaatgattggtcagcttctcaattgatcacaggttcacattattgctaacaggtttcagatgtgcctaatctcaagaaacgccgcgcctggggcatgactgccctcagcattccctctgggtggcagacgcagtttgccaacattctgcattcatgagaacagtttactgtttactcatataacctccagtggtacaccgagttgatcatgaccctccctctttcggcctgcaacatcacatgaatccaatgagtattggttagtaaaatgcctatgactagtcatcttcatctatgcaattaaatattaattcatcaaacacttcaaatgtaagcaattaataattagtgaatgaaaaatacataatacatcaattagaaaaaaactctattaaaaagacatttgtgtgataaaagagattgccatttttgtatttttctacaaagttaaagaaaactaagtcagcttatataagtgaattttaaaagcctttaggccaggcatggtggttcatgcctgtaatcccagcactttgggaggccaaggtaggcagatcacctgaagtcaggagttcgagaccagcttggccaacatagtgaaacccatctctaccaaaaatacaaaaattagccaggcgtggtggcaggtgcctgtagttccagctactagggaggctgaggcaggagaattgcttgaacccgggagacggagattgcagtgagccgagatggtaccactgcactccagcctgggcaacagagtgagactccatctcaggaaaaaaaaaaaagggcatatatatccattatttcactgggccttcacacagccctgctagtcaaccctcgagaattgaggaatcagagaacttaggaacaagaacatgacctgggacttcttatgtaagtgagaatcttaggctaaattgtcttgcggtaaatgcctttcccatcctcagaagtctatagtgagcagaaagcagtaacagcatcctcccttccactcttcccttcaggctgaacacatccctgtccctacagcctttgcagagacacaggtgacagagcactcaatatagaatccctgggctcacactggctttcctacagacacaggggatccatgaggcccacagtgacatacacatgtacacaaggatgcacgtactgacactgatgagccctggaagtcaacacagagtggcatacagaagaacacatgcaggcacacacacagccacaactggacctgcgaggtctacagccccacaaatgaaaagaggtgcataccatctcacaacaaactagaactttgagagaaccacacacacacacaggtctacaaattcacctgaacaagacgccgtccatagtcactggcgtaaggcatctactcactatcacacagaacacactcaggcaagcagacatagatgatacatccacaatctacagagatgaactgcagagttacatgcacagatatgccagtcatacattcagatctgtgtaaacagtgaggcacacacacacatacacatgtgcacttatacagaaagactcagacccagccaggcatggtggctcaggcctgtaatcctagcactttgggaggtcgaggcgggtggatcacgaggtcaagagattgagaccatcctggctaacatggtgaaaccccatctctactaaaattacaaaaaaattagccgggtgtgatggcgggcacctgtagtcccagctactcagaaggcagagattgcagtgagctgagattgcgccactgcactccagcctggacaacagagcgcgactccatctcaaaaacaaaaaaagaaagactcagacctgacctgttagtcaacagccagatgccaacagataatcacattagactcatcagcaagcacaccgtgcacacaagttccactcccatgtacaggttcctgtcccatgtacacaagcctgcacacaaacacgtatccagactccagaactgttgagacagtgcccacatacacactcatagagtcacctgtgcacaggtgcacgtacacattgtttcacagaggcacaccaggacagaaacacataagaaatgtgaggcaaaagcggacccacacctacacctgtaagatacacagagaaacaaacacatacacaaacttacacatagactcatgcactgtgtaatcaacagttctataccccaccaaggctcttgtcctggtgtgtccagaattggtgggttcttggtttcactgacttcaagaatgaagccacagaccctcgtggtgagtgtcacagttcttaaacgcagcgtgcgcggagtttcttccttctggtgcgttcgtggtctcgctagcttcagaagtgaagctacagaccttcgcagtgttaacagctcataaaggcagcgtggacccaaagagctagacacaaaagttctccacgtccccactagattagctagatacagagtgtccactggtgcattcacaaaccctgagctagacacagagtgctgattggtgcatttacaaaccttgggctagatacagagtgccaattggtgtatttacaatcccttagctagacataaaggttctccaagtccccaccagagtagctagatacagtgttgattgatgcattcacaaaccctgagctagacacagagtgctgattggtgtgtttacaaaccttgagctagatacagagtgccgattggtgtattttcaaccccttagctagacataaaggttctccaagtccccagcagagtagctagatacagtgtcgattgatgcattcacaaaccctgagctagacacagggtgctgattggtgtgtttacaaaccttaagctagacacagagtgcccactggtgtatttacaatcccttagctagacataaaggttctccaagtccccaccagactcagaagcccagctggcttcacccagtggatcccgcaccggggccgcaggtggagctgccttccagtcccgcgccgtgcgcccgcactcctcagcccttgggtggtcgatgggactgggcgccgtggagcagggggcggcgcttgtcggggaggcttgggccgcgcaggagcccacggcggtgggtaggctcaggcatggcgggctgcaggtcccgagccctgccccgcggggaggcaacgaaggcccggcgagaagtcgagcacagcagctgctggcccaggtgctaagcccctcactgcccgggtccggctggcagctccgagtgcggggcccgctgagcccacgcccacccggaactcgtgctggcccgcaagcgctgcgcgcagtcccggttcccgcccgcgcctctccctccacacctctcggcaagctgagggagccggctccggccgcagccagcccaggaaggggctcccacagtgcagcggtgggctgaagggctcctcaagcgcggccagagtgggcgccaaggccgactaggcgccgagagcgagcaagggctgtgaggactgccagcacgctgtcccctctcactgggttgctattaaaaatgggcgctgaatataaaaattaaccgggcgtggtggtgcatgtctgtaagtcccagctactccggaggctgaggtgggagaatagtttgagcccgagagactgaggctacggtgagccgtgattgtgcaactgcactccagcctgggcgacagagtgagacccagtctcaaaacaaaatcaaacacgggcgctgccctgggcaggggaggtctgggcacagctgtgctgatgtgggcagtggacaggtgtcacgtgagagcctgtggccaagcctaagctgcggttaaggtgggaggctgaagggtttggagtgtgcaccaccccggaccacctctcagtaggaatgtggcaatgcacttcggtgctggattcctacttctggctgtgtgatttgcgacacgttaccccacgcacctgtaccacaacttcctcatctcccaaatgggatgacagtagttagcaaacctccctggactgctgtgagcattctgccagaaaaatgtactccaagctcttgaagtaggcctggcgtttggttggtgctcagtacatattcaatgtttctgtcgctggcgtcatcactgtgttcatggcagagctctgtgccgccaggactgggccgccacccagaccttcctttcccgccccaggggtgaactgtggacaggaccctctggggggactaggccaaggctctcccacctctggggacccgcgcccatgggcctcagatatgtggctcgagaagggggagtgggggcagggcccctggaaaacccctcgaggccagacccaccactcccaatatccgtaagaccaggggcttgagtctttcctgcagacagatgtgggcaggaacccacccgactcccagctacgtggggacgtggacgaactaacaggacaaattctagttcctggacaccgccctcccagtatcctcgcaattagacacccatgcagcggcactacactgatccgcacacggagatacacagcgacatccgcccgcaagagcatggtgggtgccggagctcccggctgtgggcccaggaactacatttcctagaaggatgtgctagatactcgttcgcgtcgggacgcaagcaccggcccgaactcgctctaggaaatggagtctgacgcctgcgcggcgcaaacgctcccgggaggtgtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggtacagcttcactcttgtagtcagtatgtctgtggatttgcacttgaggatattgacactcagagagatcaggccagtttcccagaagcatccagcatctttttttttttttttaaatggaatctcactctgtcacccaggcgggagtggtgcaatggcttgatctccgctcactgcaacctctgcttcccgggttcaaactattctcccgcctcaacctcccaagtagttgggattgcaggcgcgcgccaccacgcccggctaatgtttgtatttttagtagagacggggttttgccatgtttcccaggctggtcttaagctcaagcgatccgcccgcctcggcctcccaaagtgctgggattacaggcgtgagccatcgctcctggcctcctgcttctttcttccccgcgcccaatcatttgttcccactcagacgtgcttgattgggggtagcagctcttttcgtcatgaattggagtgtctgagacacaggcagattattcctcgatgctgtttctgttggtgctagctactggggctcgttccccacctggccttgctggcaggttctgcctcctctctgattctcacttgtgccacgacaggtgggctttaagctcagccgtgagcctggtagccgtgaccttgactcatttctccttcgccagctctttcctctcaggatcctgctctttccctgaaagagaatctcgaggatatatcgggttggggtcttcccgaagccaggtccaaggtgagtggctgtgtgttcttccttctttatgaagagggttggcacattccctccccagccctggatcgtcagccttccacagaccttcacccgggtacctgctggccagtcctcaggaagctctgggcagtgggaacagctccaagtgaagagtccagatgttgcccgaggtgtgccctcgagatgtgctctattgaatgtctcgcccagtccaattcagtgggtcagttgctggggatctctctgcccagcgctgtgctgggagctctgaggagtggttttagtggaatctgagaaagtagttgacggctcacatggggtcgctttgcctatccacgtgctggccaggggttggtgcaggatgtttgcacggttggtttactgggactggaatcagacaggggcacgtggagcagctcaggaagggctggattgcagcacttggttaagagtggcggtaggggacacatccctgtgtgctttcctctgtacccagcccctggcatggggccttcatggagagtcctggagatttagagaatctgggggctcagcaaggaattggccctgggaacttctgcagccaaatgggacccagatccctccttttacagactgtgaactctgttcctcattttgtttttctaccgcaaccacctcaccccatggttgtatttagaagggtgcagttgacaaagagagcacagtagagtgaaagatgtggaggaataaggggtctttgggtttttgttttttttttagcattttgtgattttgtcagtctgccactcaaaagaggtgatggcagattatagccagctagaaacagctgcaaaacgtgtattgtgagctgtgcctcacttctgtagtgtgtcacaatgctttatagtcctcaagaaacttgacagtcaaatgcaatgcatgttccttgcttaggggatagatccaaaaaaattgataaagggcagtttgggacaagaggaaatttgaaaatgggctgtatcttaggtcatattgtatcaatatgaaatttattgcatgtgataatagtactgtgattatgtaagagaatatccacaggagatacaagctgaagactgtagagtgagacatcatgatgtctgcaacttaccttcaaatggttcagcaaaaaaaaatgtgtgtgcatgtatgtatgtctgtatgtgtctgtgcagctccgtctaggtggtagggccctcatgcatgtgttattcctattcctaaaatattagcttgttagatctttgaataaccagttgactctcctgagtacacatcagctttggcattttctcttgacagtctcattctcactcacagttcaagttgttctgtctcctgggacatcttgtgtggtctgttctgacttctctgctagtgtcattaccacatcagcatctgattccaatgcatactgtctgggttttttattcctttccctgcagaatgatgacacattagacatggacttctcccagtggccagaaatacccatcaaaaaggcctgtgcgggcctcagaccctaccctactcttgctggttttgctccccacactgaagccatgtagcctctgacagcctcactggccaacaccatattctgatacctgtggagctatttttttgtttttctttctttttctttttttttttttgagacagagtcttgctctgtcgcccaggctggagtgcagtggcacaatcatagctcactgcagccttcaactcctgggctcaagcaaatcccccacctcggcctcctaagtagttgggaccaacgtgtgtgcccccacacctggcttggagccttgtttcagcccattttctccttccctcggctatcgtcatccttcatgcctgcatgcctcagttaggggtgtgttctcagcatttgtcctcatctctacctcctcatctgaaatccagtgttttggggggtaaggttttattgaggtgtaatttatatacagcacagttgtacaattttaagtatacaatttgatgaggttgagcaaacgtatacagttgtgtaaccagcaccacaatcatgatatgggacgtttccatgacccaaaaatgtcctcatgcccctgtgcattcagtggtctcccctctccccttggtaaccactatagttttgctgtagattttcctctttaaggatttcatatggaatttatattatgtggtcttttgtctctgctttatttcgcttagcatatgcttttgagtttatccatattgttgtgtgaatcagtagtttgttcctttttattggtgagtaatattccatttgtattagtctgctagggttgccatacaaagtatggcaggagggcttaaatgacagaaatgtatttcctcacagttccagaggcaagaaatctgaaatcaaggtgtcagcagggttgatttcttctgaggcttctccttggcttgtagatggccaccttttccccgcatcttcacatggtcttacctcttctatgtctgtgtccaaatttcctcttcttatgaggacaccagttatattggatcaaggcccactgcattgaattcattttaactgaattacttctttaaagaacctctctccaggccgggtgcagtggctcacgcctgtaaccccagcattttgggaggctgaggtgggtggaacacttgaggtcaggagttcaagaccagccggccaacatggtgaaaccctgtctctactaaaaatacaaaaatttagctgggcgttagttctcgcctgtagtcctagctactcaggaggctgaggcaggagaatctcttgaacccaggaggcagaggttgcagtgagctgagattgcaccactgtactccagcctgggtgacagagtgagaccatgtctcaaaaaaaaaaaaaaaaaaaaaaaacctctctcggagttaccaagcattgagacataagaatttgaggtgaggggtatacatttcatcccattgctccattggatggagcaaactgctccgcagtttgcttatccattcaccagccgatggacatttaggttactcataggcttttgctattacaaataaacccgctataaatatttgagtacacgtatggctgtgcattttaatttctcttgcataaatacctaggtgtgaaattgctgagccatatagtaaatatatgtttgtcaattttattgatcttttcaaaaaacaatttttttgttttattgatttttctctattttctgttttccatttcagagatttctgatccttattatctccttggtgtcttaagattgaaacttactttacttactttagtgtcttaagattgaaacatagatattgatttgataccttttttcctcatatagcattcagcgttgtaaatttctaagcactgcctcaactatatcctacaacttttgttatgtcacattttcacttttattcagctcaaaatagcttctaatttccctagtgatgtattcttcagccatatgttatttcagaatgtgttgtttcatttcctaatatttagggcattttccagataactttctattatggatttctgatttaattctattgtcatcaaagaatgaactttgtgtgatttaaagtctttcaagtctaccaagatttattttatttcccagagtgtggtttatcttggtaaatgttccacatgcccttgaaaaaatatgtattatgcctttgttggttagagtgttatgtaaatatcagttaagtcaagttgaatgatggtgttttttaattgttctgtcagtttttgcattatgtattttgaagctcttttagtagatacatttatatttaggattgctatgagttcttaatgaattaactgttttatcattatgtaatattctctttgtctctgatagtcctctctctgaaatctactttgctattactataggcacttgagctttttttttttaaattagtatttgcagggtttatctttttctatcctatcacttttaacctatctttgtatgtaaagtgggtttctgtagcttgctttttgaattcagtttgacaatctccaccttttaattggagtgtttaaactattcgcatttagtgtaattattaatatggttggatttacatgtcctttttttttttttcttttgacagagtttggctcttgtcacccaggctggagtgcagtggcgcaatcttggctcactgcaacctccacctcttgggttcaagcaattctcctgacctcaggtgatctgccaccttggcctcccaagtgctgggattataggcgtgagccaccccacccggccttgctattagttttctatgtcttatgtcttttttgtttctcatttcctcccttaatgacttcttttgaggtaaacacatactgttctaatatactcttaattcctctgatttcattaatatttttcaccttttagttatttgattggatgctggacattgtgaattttactttgttgagtaggtttttggaattccttgtttctgggatttgttctgggatgcagtgaaattacttggcatctatttgatcctttcaaggatcaaagcaagtctggagttgggtggtggccaggatgcccaggcccagggggagcaggcaggaaggattggaaggcagtcaggtgaggactgcaggtagcctctcttagtcccttggggcacagaacttgctgatatatacaaggtttccttccttagagtgtaataacagtttctagtctgggatcggatccttttgcgttactgagctttgaatagagttgctgggatttttgtactattaatattctctcaaatttttaagtttgaaattcttgactccaggaagcatagcatctcacccaggacttagagcctgatacaacagccatgtacagcccctgggtcccaccgcaagttgccagggccctgtggtgtctattcagacctgctttcccaatctagaaggtggtgtgggaatgcatgccaattcccagcccccctccctgcccctggtccccgaattcagtcatggtcagtgtctacagcacaaccttctggcatgggagaaggtcacctgaggttaaccctttacttgtagggtccttaatcaatctctggctcctttggaaccatggacacagaatcagtcctgggtgagaacctatatgtcatttcaggaatcggtgagtttcaaggatgtggctgtggacttcacccaggaggagtggggtcaactagactcccctcagagggccttgtaccgggatgtgatgttggagaactaccagaaccttcttgccctaggtaaaatccccccagccccaggctgggcgtcggctgtcagccttcttctacatggtagatattaaggagaatcccttcagtgccggccctggtgccagatatatcatggggtgggaagcaaggcctgtgccttggggcactcatggccaggggcctcggccacgccagaagtccccaagggacagcgtgggagctggtagcatccttgcttggtgtttcccctggtcctgggataggggcagggagagaagagaagaaggtgggaccctggagcccagctggctctggaacagtcctcaagcaatgaagtaaggacgtcagcacacgtggggtcttcagagtatacactgggatttgggttccagtctgagaccctcactgcttttggcccagaggacctcctgttcccagagagggtgtccacttcacaggcattgtccttgttagggggcggcctgtaaggtcgactgggcctggagagctgcagcatgcccagcccactttctctccacgagcaggacctccactgcacaagccagatgtgatctctcatctggaacgaggcgaggagccatggagcatgcagagggaagtccccagagggccctgtccaggtgagcagaggcacaggtggaagggtgccagccccagcacccctggtggcacctcctcctatggcccctattttcctccctcagtttgccccggctccatctccccttttcaggtcccccgccagaccctcctgcctgcctcccttcagcacgtactgagcactgcctgtgtgctgagacctgttctgggatacaacagggaacaaacctggccactgggaccaaatggtcacctgctgatggggatggggaggcaggaatagaaatattgagccattggtgttggctgggcagccgggggtgtgggattgggggcagggggccaccagggaaggggcagctggcgttggtcagtgtcagggtcagcatgagcatcagcatcagggccagcgtcagcgtcagggtcagagccagcatcagtgtcagggccagcgtgagcatcagcatcagggccagtgtgagcatcagtgtcagggccatcatcagcgtcagggtcagagtcagcatcagcattagggtcagcatcagcgtcagggtcagggtcaacgtcagcgagggcttccaggctgtggccaagatggcagccctccgtaagggaaaggggactggggtgggtgttgagcagaaggtagtctgcttttcttctccaacattctttttgtagacttctcttctgagttggttgataaataagtggtaaattcggcttaatttattggacagtgactgctgagcatgttaggtgtctagaaagctcgagaaacacctttctgtgggaaaggcagccgataagctgtggagcacagaacacgggggtcggggaaggcagcccctcctccatccccctccactgccacataccacccagccccaacctgcaacagtggctgcagccccagctttctggtctttatttctcaccccagcctctgatgcttgctttgtcctctttaacaagattacaggtttcaaaaaattcatatttttgtttgattcatatatgaatatactgaaaatgaggctgaaaggttactgaaatcctgcataatctttccacccagagatgacggttctctaataactgaccatgtcactgattcctctgggcccttcctctgtgtgcggatagacttctaaagctacatgtggccaggcgtgatggctcacacctgtaatcccaacactttgggaggccgaggcaggcagatcacctgaggtcaggagttcgagaccagcctgaccaacatagagaaaccctgtctctactaaaattacaaaattagctgggcatggtggtgcatgcctgtaatcccagctacttgggaggctgaggcaggagaatcgcttgaacccaggaggcagaggttgcggtgagctgagatcgtgccattgcactccagtctgggtaacaagagtgaaattccatctcaaaaaaaaaaaaaaaaaaaaattagctgggcgtggtggtgagcacctgtaatcccagctactctggaggcttaggcaggagaattgcttgaacccgggaggcagaggttgcagtgagccatgatcgcaccattgcactccagcctgtgtgacagagctaaactccatctcaaacaaataaataaataaagccttatgcaccctcggaagcacagcactcacgccggagtctggctaccacactggccatggcatagtgagcgtcctcacgtgatgtttactgattgcacagtatcccttagatgaatgtgccctgctgtgttgttggccctattgctgccaaaacaacttttttctggcctgggcctcttctctctgctctgtgcaacttccctagactcttacctctcacttggtgtggatgtggtctacactatagcaacaccagctgagctgcagccctgtgtcactgaccatctcgtgggcctctgcttgcatgtctaaaaccagacttggaactggcccttcctcctcctttataaaagcttccaccatccacccaggcttgggtgtttgctgaggtctcatcctctcccccatttcctctcttgccaccttcagtcaacagctagggccatcagttttagcacctaaatggctcttagatctgctgcttcctgttcattttcacagccttggttccagtctgaagttgccatttttcacctgaattattcagatggcctccctaactggcctccctaactgctggctccaaccaccttacacaccaccaaagccaccttcaagacaaaccattatgccaggcacagggactcacacatctaatcccagcactttgggaggccaaggcaggaggaccacttgagcccaggagttggaggctgcagcgagctgtgattgcacccctgcactgcagcctggacaacagagcgagactgtgtccccgccctctgcttcccccgccccccgtcaagacaccatatgatcacatcaccctctgtgcaaaaggcctttcttccccggctgccctctgagtcaggcatctggtcacctcgaacccatccaccttgccagggtcacctctcagccttcctgcctctgcgtgtcttgtcttcatcttactgtctcacctctgagcttctgcacatgctgttcactctccacctggctacctgccatgtgtgccatggccagttccacttgccctgctcttctgcatgtgttggggccacaggcagcaccaccatgcagctctgcccgctgcactagactgctcccttttaagcctggggaggacagaattagaaataaaatctcctgccagctcagaaaaccttgctatagagatagaaaagaaagaaagccttcttattgaataagtgtttaaccagatgtggtgtacaggagagaaagaaacctccccctttgacagaggagacacatccaacccagcacacagggcaactgtcttcacctaaaggaagagtacagctttttgggttttgtttgtttgtttgttttttgagacagggtatccctctattgcccaggctggggtgcggttgcatgatcatagctcgaagcctcaacctccctaggctcaggtgatcctcccacctcagcctcctgagtagctgggactatagacaggtaccatcattcctggctaattttgtattttttgtagaggggtctcactgtgttacccaggctggtcttgatctgggctcaagtgatccgccaccttgacctcccaaagtgctgggattacaggtatgagccaccgcgcccagcctcttgtagctttttgacaagcaggaagttacatcttggactcgactcttggactaggctcattttgcttctgaaaaggtttgcatgcgtctcgagacagagaaagcatttgcaattcccagtgttctaaagggaagcgctggggtgtggggagcccttttttccttttggcaccacagacaatttttaattcatttgttagtcctagctactcgggaggctgaggccggagaatggcgtgaacctgggaggcggagcttgcagtgagccgagatcgcgccactgcactccggcctgggcgacagagcgagactcggtctcaaaacaaacaaacaaacaaaaaacatgtatttgtcctgtgtattgcgagcacctgccatggtattgatacagagcagtcggtcagccgacgtgtccgtgaatgagtgtaatcctcatcaacagctcccaagcttgcccctttctcagcccccttggtgcttgtagctgttccttccgggattcctttggcttctccgcctctcccggtctttgctctctggtagctccttccgtgttcttcctctcccttcttcccgctcttgcttgcccatctcatcctgggcgctcccttctctctgcctgcaccttccagccttggccctggtggcctctcctctcttttctgggcttatctgcatctccaggccaattctcaaatctgaattctaggccaggtttccgcttgctcacagaaaatcattttcaatatcttacagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacattaccctctgctttgttcatgtagaactttgcattattttcaacacagtgtatctatagtttttatcttttttccctctttagctttgtagcagatttttttttcaagcatctaaactgtcctcgttatacttcttttttttttaaattatactgtaagttctagggtacgtatgcacaacgtgcaggttagttacatatgtatacatgtgtcatgttggtgtgctgcacccagtaactcgtcatttaacattaggtatatctccaaatgctatccctcccgcctccccccaccccacaacaggccctggtgtgtgatgttccccttcctgtgtccattgttcaattccaacctatgagtgagaacatgcgatatttggttttttgtccttgcgatagtgtgctgagaatgatggtttccagcttcatccatgtccttgttatacttctaaacagaggcacagtgttctctctggtctcttagatactcttttgttggatgttgaagttatttccatggtgcagtggtgtgatcacagctcactgaaacctcaacctccctggctcaggtgatcctcccacctcaacctcctgagtggttgggactttgggactacaggtgtgcgccaccacgcccagctaaatttttggggggggcagggggtctcgctgtgttgctcaggctggtattgaactcctggtctcaagcgatcctcccacctcagcctctcaaagtgttggggttacaggcatgagccactgcacccagtctattgatctttctttttgaaaaatatttgaatatgccctttgtccctctttatattggagtcttgatgtttttcttttatgtatgtaaaaacttttccctgattatgaatattatatgtatactgcagaaaatttttaaaaatcacaaaatcataataaaaatgaccctcaggttccagctcagtggctcatgcctgtactttgagaggccaaggcaagattgcttgagcccaggagttcaagaccagcctgggcaacatagggagatcccatctctacaaaaaatacaaaaaaaaaaaaaaaattagctgggcatggcggtgcgtgcctgtagtcacagctactctggaggctatggtgggaggatcacttgagcccaggaggtcaaggctgtagtgagtcataatggcaccactgcactccagcctgggtgacagagcaagactgtctcaaaacaaacaccttcagaatcagttcatggatcattaccattattaacatttagatgcgttttcttgcagttgttttctatgcatgtatacatatcttttttcttttaaaagaaaattaggctgggtgcggtggctcacgcctgtaatcccagcactttgggaagccgaggtgggcagatcacctgaggtcaggagtttgagaccagcctggccaacatggtgaaacccctgtctctactaaaaatacaaaaattagccgggtatggtggccggtgcctgtaatcacagctagtcaggagcctgaggcgggagaatcgcttgaacctgggaggtggaggttgcagtgaggccagattgtgccattgcactccagcctggtcaacaaacaagagcgaaaccctgtctcagaaaaaaaaaaaattagattcatattctacatattatttttatcattttccatttaacattttatgataagcattttctatgttataaaatattttcagacataattggccacatcattttctgtcttacagttgtatcttaatttatctattcccttactattgaacatcaagattgtttgtgcctataaataattatttaacataggcctctgttcccatctttgatcatttcctctgagtacgttctgagaaatgcagttaactggtgaaggttatgaacactgaagctcgttggtgttcctgggtggaatctgatctggtggacctgctgtgagctgttcccatcggctctgacatgacgctgtgagctgttcctccctggacgaacatgttcctcccatgacgctgtcaccactccctggccagcatggggtcgttccggccttgatttttatatctgccattttgaggctttaagaatgttatttgtccctgcttgttggccgtttgtttttctcttcatatgtgtggtctgttcttgtcttttgtccactattctctttggtttatttcacacacacacatacacagagagacacacagatgcataaatgacatacacatacacacataaacagatgcataagcacagacacacacacacacatatatatccccttggcatgtacattttctgtctttgttacagcatttttaatgcccagaggttttctttttcttttttcttttcttttctttttttttttttttttatgagatggagtctccctctgttgcccaggctggagtgcagtggtgtgatctcggctcactgcaagctccgcctcccgggttcacgccattctcctgcctcagcctcccaagtagctgggactacaggcacctgccaccacgcccagctaattttttgtatttttagtagaggcggggtttcaccgtgttagccaggatggtctcgatctcctgaccttgtgatccgcctgcctcggcctgccaaagtgctgggattacaggcgtgagccaccgtgcccggccaaaaaggactcttaaaactcaacaataagaacatgaacggctgggcacagccgttcatgacacagatggctgtgtcatgggccatagaataatttaaaaaacaataaaagtctcagctgggcacagtggctcatgcctataaacacagcattttgggaggctgaggtgggaagatcacttgaggccaggagctcgagaccaacatggacaacatagcaagactccatctctaccaaaaaaacaaaaaaaattagttgggcatggtaatatgcacctgtaatcccagctgcttggagacttaggcaggaggattgcttgagcccaggagttcaagtctagtgagctatgattgtgccactgcactttagcctgggcgacagagcaagaccttgtctcaaaaaaaaaattctattttttaataaatggacctgaatattttaccgtaggtcttcccaaagggtccagggatgccatcacccgattgcatagctagaaagcggatggactttttagtaagtgtgggttctagtaagtgttgccgcactgaagaacatctctggccaggcgcggtggctcacgcctgtaatcccagcactttgggaggccaaggtgggtggatcacttgaggtcaggagttcaagaccattctggccaacatggtgaaacacttcctctactaaaagtacaaaaattagctgggcatggtggtgggtgcctgtagtcccagctacttgggaggctgaggcaggagaatcgcttgaacccaggaggtggagcttgcagtgagccgagatcatgccaccgcactccagcctgggcaacagagcaagactccgtctcgaaaaactaaaaaagaagaagaacatctctgctctcagcttaggtcctgggcccctaaagtcagcgaggcagccattgtcctagggtgatacgatgacatggatttgggactccctggaggaggccacacacacacaaaatgcaactctacaaggggagggaacagaaactgaaacaggtatctgcaatgtgcctggatccgaatttcaaaatgtgttgaagaattatggatttacaccatgagaaaagcactggttggcttttgtgcctgcttcactttggctctgagttaacttcaaacactgccaaacacaatgctagcacatggtgaccctcaaactaataatttataagatgggatccacttccccggtggaagtggccacatgctgccctctccccacccccacggcatacttgggcatgacctgcagccttttgttgccatccaggttcgtgttcattctgctggtgcagtaaatcaaccactatgacatggttttgcaaaaaagaaaagatttattcacaagggcactgatcggggaggtggatcctttttaagtccttaagtctttcgtcccccgaagataagtaacagcttccttctgtgtgagcatggctggagttcatggcatttcacaagacacgtgtacagaagagggtagcattagcattttccaaaggcggagtttttggccctccagtgtcaaaaggccacctttcgggcacttgtgcaggcccaattgaagggttggtggtctcaaccagtttgaactggacaggagctggcccaagttcctgaaaaacaactgaagaagccggcaccatggtgacttatgcatgttatctatacagtagccagggaaggttaagtttcagcattcagcggcaaggctttcagctactgtggcccttaagcttcacagaaaaaggagaaaaaaaaattaaaaaccaaatgacccaaaagcaagcagagcaggcagacctggccaaattaacccttcagtttcactttcccttgctctgttgggcatttgtggcttggaaaatggccccctcctgccgcagacagaccctttactgctgacaccaatcattacattgatctgtcgtggttcagtgcaccactgcactccagcctgggcaacagagtgagaccctgtcaaaaaggaaaggaaaggataggaaaagggaagagaagagaaaggggaaggggcaagggaaggggaaggggaaggggaaggggaggagggagggaaagaaaggaagaaaataaaagaaagaaaagagaaaagaaaagaaaaagaaaaaaagaaaagaaaagaaaatgcacagtgagttagatttggcctggaggctgtagcttgccaactcctcctctggattcatggattagagtttaaggaagagatggagaagtatggcagaagaactggagtgaggccgaaccccgtggtgttctagaagaaaggctcttgacacaagcatctggcagttatttttcaggggagaacctacaaattataaggctgtgcagctccccttactagtcaagtgattacacttttgttttcttttatttttttttagagacaggatctccctctgtcacccaggctggagtgtggtgccgcagtcacagctcactgcagcctcgaacttgtgggctcaagtgatcctgcctcagcctcctgagtagctgggactacagacacactccaccatgcctgggtaattgtttctagttttgtagagatgaggtctccttgtgttgcccagaatggtcttgaactcctcgcctcaagcaatcctcccaccttggcctcccaaagtgctgggattataggtatgaaccaccatgcccggcctcatgtgactactcctacagaggccctcgatggcctggaatgattgattccaggaccctgtcttctcatcccaaagcaccaaaccctactgacaaggaaagagcccccatttcagaacttccatggccaccccccaaccctgggattggcaactttgcaacctgggcttctccgataatcagatttacggtaagaccccaaagaggtccaggcgcttctaaaacaagttagacagagaatccaaacccaaatcctcaagatgtgagcccacatcacatcccccaaaatagagcatccgtgaccactccagccttgctagggacacagcatactccttgaccctcaccaaaggacaattgctctcacaaacacggggatccactggttcccacgcactaagcaaacttttatggccttaattgacactgtttccccagagaccccactaaatgtaagggaggaaccctctctgttccctgggacataagattgaaggcaaacaagtccgccttagcctgatcactggtgcaatagctttgcagaatattccagtggtctcagttctttctgctcttgaatttctatcactgggacagatgctccaattggaataaaacccacactttgtcccttactgttggtcttggcagatgagaccctgaggacctgcccaagccattaaaatcattaatatgacccaaaataaattaaaacagggacttcaaggattgagagaaggggtgaccatcccctctgtttctccatttaacagcccaatttgacgtgttcttcaaatggaaaagaacaaatgacatctcacagtcgatgctgaaaccttaacccagggggccatgggggccccagcccctgcagactgaaaggatggagcccattcagtcttttgctggccgatattttgctatttttgcttccttgcagtgttccacagtacctaattcaacaggctctcagcctctactcccattctatttattgtggtaaaatatataacaaaatttaccgttttaacctttttctttctttttttttttttttgaaacagggtctcactctgtcacccaggctggagtacagtggtgccattgcagatcactgcagcctcaacctcctgggttcaagtgatcctcccacctcagcctcctgagtaattaggattacaggcttaagccaccatgcccagcctactttaatcattttttaattttaattttatttatttttttaaattttactttaagttctgagattcatgtgcagaacgtgcaggtttgttacataggtatacacatgtcatagtggtttgccgcagctgtcaacccgtcatctaggttttaagccctgcatgccttaggtatttctcctaatgctgcccctcccgcagccccccatcctcagacaggccccggtgtgtgatactcccctccctgtgtccatgtgttctcattgctcaactgccacttataagtgagaacatgcagtgtttggttttctgttcctgtgttagtttgctgaaaatgatggcttccagcttcatccgtgtccctgcaaaagacatgagttcattattttttatggctgcatagtattccatggtgtatatatgccacattttctttatccagtctatcactgatgggcatttgggttggttccaagtctttgctattgtaaatagtgctgcaataaacatatgtgtacaggtgtctttacagtagaatgatttataatcctttgggtatgtacccagtaatgggatcactgggtcaaatggtatttctggttctagatccttgaggaatcgccacaatgtcttccacaatggctgaactaatttacactcccaccaacagtgtaaaagcgttcctatttctccacagccttgccagcatctgttgttttctgactttttaataatcgccattctaactggtgtgagatggtatctcattgtggttttgatttgcatgtctctaatgaccagtgatgatgagcgtttcttcatatgtttgttggctacataaatatcttcttttgagaagtgtctgttcatatcctttgcccactttttgatggggttgtttttttcttgtaaatttgtttaagttccttgtagattctggatattagacctttgtcagatgggtagcttgcaaaagttttctcccattctgtaggttgcctgttcactctgatgatagtttcatttgctgtgcagaagctctttagtttgattagattccatgcgtcaattttggcttttgttgccattgcttttggtgttttagtcatgaagtctttgcccatgcttatgttctgaatggtattgcctaggttttcttctagggtttttacggtttttgggttttacatttaagtctttaatctattttgagttaatttttgtataaggtataaggaaggggtccagtttctgttttctgcttgtggctagccggttttcccagcaccattattaaacagggaatcctttttccatttcttgtttttgtcaggtttgtcaaagatcagatggttgtagatatgtggtgttatttctgaggtccctgttctgttccattggtctatatatctgtttaaaaatatggaacactttggctgggtgcggtggctcacacctgtaatcccagcactttgggaggccgaggcgggtggatcatgaggtcaggagatcaagaccatggtgaaaccccgtctctactaaaaatacaaaaaattagccgggcgtggtggcgggcgcctgtagtcccagctactcgggaggctgaggcaggagaatggcatgaccctcggaggcagagcttgcagtgagccgagattgtgctactgcactccagcctgggtgacagagcgagactccgtctcaaaataaataaataaataaataataaaaaataaaaataaaaatatggaacgcttcacacatttgcgtgtcacccttgggcagaggccatgagaaacttctatcgttctgattttagtatatgtgctgccgaagcgagcactattttaatcatttttaagtgcacggtttagtgacattaagtacattcactgccatctatttctagaatcttttcatcacccgaaactgaaactctgcattcctattaaacactaattcccatacctcccagcccgtggtaaccacggttccaccttctgtttctacagaattttttttcttttttttttttttttttgagatggagtcttgctctgtcgcccaggctggagtgcagtggcgtgatctcggctcactgcaacctctgcctcccgggttcaaacgattctcctgcctcagcctcccaagtagctgggactacaggcacacatcaccatgccctgctaatttttttgttttgttttgtttttgttcatttgttttctttgaggcaaagttttgctcgtcacccaggctggagtgcagtgccgtggcagtggcgcaatcttggttcaccgctactctgtctcccgggtccaagtgattctcttccctcagcctcccaagtagctaggattacaggcacacacgaccacatacggctaatttttgtatttttggtaaattttgtatttttggtatttttgccaggctggtgtcaaactcctgacctcaggtggttcactcacctccgcctcccaaagtgctgggattacaggcgtgaggcacctcgccccgcctgtctctacgaatttgactcctctagatactccacatacatggaactgcacagtatttgtcgctgacttctggctgtcctcacctggctatgcctactttgggggataatctgggcctgggacaccacatccccgtagcaggccccaccgggccgcacaaacagaactgcgccgaagttcccccaggctgttacccccacttgtttaggctcttcaaagatgctaccggccgggcgtggtggctcatgcctgtaatcccagcacttcggtgggccgaggtggtcagatcacttgaggtcaggagatcgagaccagcctggccaacatggtgaaaccccgtctctactaaaaatacaaaaattagtcgggcttggtggtacgcgcttgtaatcccagctactctgtaggctaaggcaggagaatcgcttgaacctgggaggcagaggttgcagtgagccaagattgcgccactgcactccagcctgggcgataaagtggatactctgtttcaaaagaaaaaaaaaaggtggcaccggcccggtgcggtggctcacacctgtaatctcagcactttcggaggctgagatggaaggatgtcttgggcccgggggatggaggctgcagtgagcggttattgagtgactgcgtccagcctgggcctcagagtgaggccgtgcctcaaaaagaagaaaaaaaaaaaaaaaaaaagcagcagctacccatccagccgccagatggcagcacgattccatggcccccactagccgctggctgcctggtgccggatgcagtccgaaaggcggttctgagctccaagggccggcgccgcgcgtgcctgcggtcccagctgctcgggaggcccaggcaggagaatcgcgtgaccgggagttctgcgctgcagtgcgctgtgccgatccaggtcctcactgaagccggcatcagtatggtggcctctgccaccaggccgcctagggaggggcgaggcagccccagttggaaacggagcgcgtcagtagtggcatcgcgcctgggaatagcctctgcgctccagccgggtcgacctgccgagactccgcctctaaaaccagcaaataccgggaggctgagggacgaggaccgctggagcccgggaggcggaggttgcagtgagtagctgggattacaggcaggcgccaccacgcccgggtaatttttgtgttattagtagagacggggttccaccatgttgaccaggcaggtcttgaactcctgacctcaagtgatccaccctccttggcctcccaaagtgctgggattacaggcgtgagccattgcgcctggccaaataagtaatttaagcaattttttttgtttcagaaaaaaaattaactcataaaggagcccccccgacacacacacacacacacacacacacacacacacacacacacacacgggaagcagcagtgtaattggaatgcccactgctgaggctctcgaatgagtgtcatgtgtgcacattttgcccctcacaatgcacgtcagactattaataggaagcagccgctggaatacctctggtggggtgtgtgcagcaggcagctttggaattacggtatccccaatgtgacagcaggacaatggcttcttcactggcactgtccaaccacagtgctgtggttatgtctcgaggtccattattgggcgaaggtcactgcagactcagggaggcccaggagctcaccccaaccagcttctttaccaggtgagtgacctcagccctgcagctggactcatggagacaatgacctcacccgaagatagatgacccctgtccaccgtccacacaacaactgaactggccccaggttgactcctctacaccctgcttcctactgtacccctgtcaaaggccttcctcccacccttcccactcctcttcctccctggcagcccaaccaccacaaattcactaacttgttttcaactcttacaggctgccctcctaaccctagccctgacctctgccctcctaaccccagccctgaccccaccgccctctcaggaggctttaccaatcctctgcatgttagccccacccaaggaacaggcctattttcaagcatactaactgttgggtgtgtcgcttacctatgcatatgacagccaatccaacctacctaaatgacagcacagctccatccatggatgtggctgatcacatctccaaaccatcttcccactggggacaaattcttggattttttagagacaggttctcactctgtcacccaggctggagtacagtggtgagcctcagactcctgggctcaagggatcctcccacctcaacctctggagtagctgggactacaggtgcacaccaccaccgtgcctggctaaatttttaatttttttttttttttttttttttttagagatgggggttgctatgttttccaggctggttttgaactcctatcctcaagtgatcctcccacctcagcctcccaaagcactgggattatagatgtgagccaccaatcttagcccaaatttttaactaaactcaattaaacaaatgaacaaacagaaaagactctcaaaccacacactgtcgtctctcacccaacagagacaagacgtctataaaccaccaatctgtttaaagagaccaccaaatgttcagaccatgaaactgaaagaatcaaaataaagttgtcactatgccaccaacggacaaaagccaggagcacacaaccaggggtcatactcactgaaggtcccccaccctgatggccagtcaggggcggcttgcgggtctcagagagggctcaccacctgcttgcagtcattggggatgggaaggtaagtccaacccatgccaggtcaaggcacaaagactgtggggggaatgcaccagacacataaagagatgactttattcaggctactgctatgggaagaaaactcactaatgaggaaggaggggcctggtaaataagagactcatgtggaaggctggaggcggggtcttagaatggacaagggcaaagtgctccttctggtctcactatttctcagaacgcaaaggaagaggcaatttctcagtgagcaccatttccctggaacccagggctgagatgaatttcagtactgccagcggcctccgcgttctcctgtgtgtgtaggagtttgtgtgttccagtgtgcgtgttcccactgtgtcttggtgtttctgtgtgcctggtggcatgtctgtgtgtgtatctgcagggtgaaagaccacagatactatccgaattcccgtgctcaagtgcgcctcctgccttggctttcctgagtgtggggatgacaggcgtgagccaccacgctgggcctcatgatctgtttctagtgcagtgagtgcatcttagggtgggtgcccgcctccatgcttagtagggcatggatgctgtgtatgccatctgtcggtaggatggttacacttctgtgtgttggctgatgtgtgtgtctcagtatttagtcggctctggtggcacatgtgtgtgttgcaggttgtataagttgctgtttctctgtgtctggtggaaggtgtctatggttgcagagtgagggtctcttggtgtttctgtgtgtcagagggtgtgtgtgtgtgtgtgtgtgtgtgttttgcaggatgaggtgtgttctgtgagtgtgatgtggggggtgcagggtgcatatctgtgtctacatttcttttttttcttcttcttcttttttttgagacagagtctcgctctgtcgcccaggctggagcgcagtgatgcgatctccactcactgcaaacactgcctcccaggtttaagcaattctcccagctcagcctcccaagtagctgagattacaggcgcatgccaccacgcccggctaattttttgtatttttagtagagatgcggtctcaccatgttggccaggctggtcttaaactcctgatctcaagtgatctgcctgcctcggcctcccaaagtgctgggattaacaggcgtgagtcactgcacccagcctgtctgcatttctgtctggtggtgagctatgtgctgcaggtagtgtgtttaatgtgtttctctcatgtttccgtgtatctggtggaagatgtgtgtctgcaggatgagtgtctcttttgtcggtgtatcatggattgtgtgtttgtgtgtgttgcagggaatgtgtttgtctcagtatctgagtgtgtcgggtcgtgtgcaggtgtgtgtttttttgtgtgtttgtttgtttgaaacagagtctcactctgtcgccaggctggagtgcagtggtgtgatctcagctcacctgcaacctccgcctcccgggttcaatcgattcttctgcctcagcctcctgagtggctgggattacaggcgtctgccaccacacccagctaattttttgtatttttagtggagacagggtttcaccatgttggccaggctagtcttgaactcctgatctcaagtgaaccgcctgcctcgtcctcccaaagtgctagaattacaggcgtgagccaccgtacccggccgcacgtgtattttgtatgatatatatctgcttctgactttggtgaagtgtgtgtgtcgcagggttgtgtctatcttgtggtttctatgtggcctatggtgtgtgtgctgcaatgagtctctgtcttggtgtttctgtgtctggtgatacatgttgtatgttgcagagtgagtctttttttccatttttatgtgcgtggtgtgggttgagtgtcctccatagtagtgggctggctgtgtgtgtgtcacagcgcgtctgtctctgtgagcggtgggttgtgtgtgtgtgttggagagtgagtgtttctgtctgatggagtgtcgtgtgtgtgtgtgtgttggcaggtgagtggctgtgttcctctgggcccagtgctgtgtgggcgtctgttgcagtgtgtgtgccgtctctgtgtttctgagattctgctggctttgtgtgtgcatgtctgcgtttcgggctgtgtgtctgtgttggtgtttctgagtctagaggagcgtgcatgcggcgtagggttagtgtctgcaggcctctgtgtgctgtggcctgcgtctgcttgtaaccaccaggctgggcctggtccccacattcctcccactccattgtgctctgtgctacaaaaaatatttgcgttttccaccactcataatttttcctcctcaatcgctaccagatgtgggtcctgtggtccccatccccatggcaacggaggttccagcagccgcggttcccttttgtggcgcctgccctgggagctggcactgctgtgagccccgagggggtggggagaagcgggtggtgggaggcaggaggctggaggggtcccagcagctcccttcccagcagccactggaaccctcctggggggaagggaaggctggtggtaggttggggggggtcccctgttttgtgaggcacccacaggtagagtcttcgacacctagggggcttcccagagaagggcaaggagaggtccccagaaaggcctggtcactgggacatccctgttctctccaaatcgtgctggtccaggctgggggaggagaaatagcaagagctgagggcttgggggttcagggaacagcagtgtggcatcctcatcgttctggggggtgggcaccgcctagacaagaatgtggtctgagcccctgcactgcccacccctcacccacacgcaggcactgccctgccctcgcggagcccggctgggcatctgccctcttggccttaaccccagcagcccgcatggcgcagtgcccaaacagagcagaggctttccagccacagggccatggctgggagggtgcccagctggctccagggaagcagtatggcccagaggcagggatcccacattccacgtgctgcctgtttgtgtcctgccagctgctctggacggccgacccagggcaggacgcagtctccactcagatggctgggccttctgagatgggtgacccctctaagatgggtgaccaaagttgacctccgtggggcatctggtcagaggatgagagtgtgcccaggacgagagccccaagttgccagcgtgagaccaatgagtgctgtgtggcggctgcagggtgatcagaagatcctggcagcaggggaagactttgagctgggcatcaaaagatgagatgcaggagaacaagaagaggcctgccgggcagaggcaggaggtgggaggagaacagacaggcaggagctgggggaacttagtgtggggacagcaggggccatggaaggtgagggtctgcggcttaggagggtcacttaggaggcctgcccgggagggtaggcgggtcaggagcagcgaggccgtagggcacagatggtcacagatagccaggcagccgggtctggcttgggggcaggggatctgccccgggcgctccctccgtctccctcaaccttccgcagtagcaggcggggctggcaggcaggagagtttccggctgaggacaaggaacccgttgaggcagacagcagggctctgtgcagcaggagaccggcttgtttgtgctggaggaggcccggctggagtaagcgcccgcggccccctggccgcagcctctgcaccccccgcaagctgccaccaacagctctgaggcccaagtttaacagcagcggccaggggaaaaggccgggatccgaggcaggcccatcgcctgtccctttcagtcagggactctgcctgatctgcccccacccaaccttcctccccgtgaccagtccagaatggggcaggccagatcggggccgcataaacttgataaacaaacgaagcctgtgggttgacacagcccacttccaccatggtcccgggagacccacgcctgggctccagggctccccgctgagataaggggtgggggagagtgcaggacaggtcgtcacataaagttacttctggggggcatctttggccgaagcctgcaaacaggaagtgatcagagcatgaggggaaaggcattttattaagaaagctttggccaagcccccgccgggaggagcccatcctggggcaccggccgaggggggagcagccctgctgggggcctataaatacatctcctcaggccactagagtcgcccctggaggtcccgcggcgtgtggggcagtgggaggccatcaaaaccagctgacagctgaggggcctgggcccggggcgccagggaagggaaggggtgggacggactaagcccctgaggagcggagaccagccctcctccccaggctggggtcaaccagatgcccgggagcctggccagtggaagtagccccgggctctattgggacggccaagggagggagcctccagccagaggcaccaggccctagcgggggagaggcagcccgggcagaagtgcctctggctgcaaccaatgagaaggtagccctaaccaagtccactcctggccagtaagaggcggtctttaagcggaaccctcccatctttggccaatgagacgctgtctggtcggagcgctccataactcggccaatggggagggagtcgcccgctaagcgcctgtcaggcctcgaccaacgggatgggcccttcccgccagagcacactgctccaatccaggagcggctgcaggacctgagccaatgagacgcaacctccgctagccgcgcggtgcccggccaataggaggccgcccgtgcccggtagcgtgggaggtgtggggtggcgggcggcgctgcgaagctgagggagctgcgcgcggacgagccacagcctgctacagggtgggtgcgcccgccctgcccagctcgcccgccgcctcccggctcttcttgcgcggcggcttctggatgggggtcttcttccggggggtctcaggcgcgggcaagtcggtcgccgccttctcaggccccggggtttcggtcgctgggggcgcgcgggcgggcgaggctggcggcacggagcgcttggctttctgtgggggcgccggcttttccctggggccctgcgcgcccagggccacctcggcgcggcccaggctgcgagtcttgccgcgcacgtcagcggccaacatggaggcagcctcggcgcgcttcgcgggggaccgccggcgtccgtgggctccaagaggccggggcgcggcgcgcgctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtacagagcccctccgggcccctccacgctggacgccgaccgctcgctgtcggaggacgcggggaggggtatcgcctcctcggcggaggctggcgtggtcaagggcacaggggacggcgccggcgcctcggcagggacagtggggacttcggggtcccggctctccgctggtgcctctggcaagggaagagcagggcggtcacagccttcaggaatacctttaggggctccaacctccaggcgcaaaccttcacctttcctcctctacccacgcccttggcactgtgtcaccctggcatctagacgtgcctggcacagagcaccaaccacacatgtgtacttcagagcctcaggctatgcggctgactctgaactcaggctgtgcaaggagtgatgggcgcattcccgcgactgaagcccaaccttggcctggcctggcagccctgccccaacacccctccagccttgggcgcctgcatcatcgaatttgaggctggaacatccccacaggggttccattatccttctttaagagagaaggcttctagctgggcgtggtggctcacgcctgtaatcccagcactttgggaggctgcggtcacctgaggtcaggagtttgagaccagcctggccaatatggtgaaaccctgtctctactaaaaatacaaaaattagctgggcgtggtcgtgggcgcctgtaatcccagctactcgggaggctgaggcaggagaattgcttgaacccaggaggcagaggttgcagtgactggagatcatgccactgcactccagcctgggtgacagaggcagactccgtctcaaaaaaaaaaaaagagcgataaggcttctgaggctctgagttggtcacctgcccgtggcatctgggggcacagtcaagggaggagacagggcagaatcccagaccatcaggctcctttctgctatctgtggatcaaaggctgtgtgtggatccaactcccatactctgtggatcccttcctcctgtctcctctgccaccccctacctaagcccagaaacttctctctgcctactttcccccaggagcaaccctgggctgtggcctacccatctccccacacctgtctccggtactgagcagcagagtccagctctatggcctcagctctgtgggcaaccctcaggtaccagcatggccaaggccttcctctccatgctgcctgcccttctcctgtgtcccacccagaacacagcttttccatgggaacatttcactgggctggagtgatgcccaggtagggccttacttaccctcatggggtacacagtacacagggccttcatcagtggtgtcaaacgaggagaaggaggcccgagaggaccaggatggtgagggctgctccagccctgagggtggctccaggaagctgcagttgagtgtgttatccaggtcgtggtgggccactggggaaggatgaggcagagctgccaggggtccactctgccccagccggtgccctcattagcccctgctgtgacaaatgttgatggggtgaccaagaccagccctattcttggactgcagggggcacaggcaactcaacaggtacagtgacactgggccaggactggagaatgggtagaggtgaacccagaaaagaaacatgggcacaacatgtgttaaggtgcaaggcaagtgtgtgcatccagggagctggaaaaggttgggctgacgtgttgagaaaaggccagaaaggtgggagacggggctgaagaagacacctggctgggacaggccaccaaggcctccaagctctgttttaggccctgccttgtgcgaataaggaagccttggagcacttctgagcccaaatgcgcagtggcagggctgccctttggctcagcccatctcagcaagctgcaccctaggcctggcctccagagatgcagaccccacaacagggggccccagaagctggctagcctggcctccattccacagagggatgtggggtccactccccacacctatgtccccagatgccatgctgctaggtgggccaaggggttttctctctcttgcttgcttgctttttcttttctttcgacagttttggggtttctcctccctccctccctccctccctcccttccttctctttcttcttttctcttctcttctcttctcctctcctctcctctcttctcttctcttttttcttgacagttttgctcttgttgcccaggctggagtgcaatggtgcgatctcggctcactgcaacctctgcctccctgcaacctctgcctcccaggttcaagtgattctcttgcctcagcctccagagtagctgggattataggcatgcgccaccacacccggctactttcgtatttttagtagagaccgggtttctccatgttggtcaggctggtcttgaactccaggcctcaggtgatccacctgcctcggcctcccaaagtgctgagattacaggcatgagccaccatgcccggcttggctaaggggttttctcagctgtttccttcatctcccaagagtctgagcccccttcccctccatctttagaaataagtgggaaagagaggaagagagggtccacccaggtgcaagtcagcatggagagaagcggcacaccccacccccctatcctgttggtgggtggggaccagcctgcccactttccaggaggatctctgggtactgctggggatgtaggcaggagggtgggtcctctccgtggggcagggcactcccgtggccacgcattcccccagcagctctggccgggatatacagcattctcctacagactgggggagcctgcgggacccagatgtccacacacccctgatgcgatcactctcagggccaacgtttctgacatatgcccacatcagccggcgcacctaggactcctgccttcctaccttgcctcgccctcagcagctgccacacctcttaccttccctctggtcgcacctcctcgcgcccacgcacatcaacactcaaggtcccccatttcctcactgagatctggaccccctcacacccatttcccagcagcttcctgcgtcgagaggtgtttctcccagataccccgcgctgtcatccttacctacgactttgggtagtttctgcctccggagcgggatccggggcagcttcatgctgatgcgactgaagcgcccgcatagtcggtgcggcgccttcttcctcccaagcgaaagctccctgcgggggcggggtctgagcggaggggcggggccggggcggggcccaggggcgattagatctcggccggagccaagcacagaaggggcggggccacgtccggggcaggggcgcggaagggttggatctgggtccggtggcacccagagggtgcggcctgaacccaggcgaaagcggggcagtatctgggctcaccggcgcgtagggtccttgccgcggcaagcgcagcagcagccgagcagcgagagcagcaggcagacgagcaggacgagcagcgcgcccgcgcccatcacgcccttgcgctggttggtttctgtagggggttatggggtcagcgcggtttctggcaccccctgcattccttaacgggacgcccctcatccacttacctaggtggcaggcaccagtgaccgggtcgcacgtgtcctcgtggcagctgcaggcctgagcacagtccgcgccgtggagtccgggcgggcacgtcacgttacagctgccgggacatagggtcaaggcatgccacagccgcccccctaggatgccccctaccctcacccctcacccgcggccagggcccagggtccagggtcccagaaccgggctctctctcgctgcattcgtcgtctagggattgaagccccgccccgcccgtggcacatattgggtagtggatgttttggaaacgaatgttgcacaacactagtgggggggcctgggggataggacccgtggtggccgcgccgcagcgcccactgctggggctgactcggctaggtgggaagaggggctgctgaaccagacccttggctgtaagtggaggtccctggtccttctgtaccaactcggggtcaccttaagagcccactgacacaggctggactggtcaccagatcctgcgctgaacgtgagctccccgacatccaggcaggaaactgcccccaaagagcctactgtcactccctagctggggtaagggaccaaggctgaggtgataacccagctcagggtggagaggccacctcgtcggctggacccccctctgtggcaggtacaagcccccaaccccctcccggtcccggggcactcactggggcccgtggacgccagggctgcacaggcagcgccccgactggaagtcgcagtgtccgctgccgcagtcggcgcacacgaaggcgcagtcctcgccgtaagtgccattgctacacttggtctcgcaccttggaaagaggggaggaggcgtcagcagaaatggaggcaaacggaccacagcgccctcgacattggggcctttgttagggaggcagggcgggggactgcgtgtctgggccgacgcaggcagggctgctcaccggtcgccgatccagcccgcgttgcagcgcgtacacttgccggtgacatggttacaggcatgcccgtcgcggcatggcggacagcggtggctgcagccctcgccatagaaaccggtggcgcaaggctggtcgcacttggttccgttccagccgggctcgcacgtcaagcagcggccctcggccaccgtgcacggctgctggcccttgcactggccacacctgggggaggggtcggaggctagggaaggctgggacccgcctcacccctgtccccatcggcggcccgcccttccacctcctccctccctggccgagagaccgcgcttaccggcggcgacagcccaagccgtagaagccggcggggcacggctcgcgacagtacttgccgcggtagcccggctcgcaggcacacgtgccgtccacagggtggcagcggccgcggaagcactggcagtagcgatcgcagcgcgcgccgaacgtacgctcgcggcactgacagcggccgctctgctgctcgcagggagacgagttgcaggcgcactggttgttgcagctgcggccccaccagcctgcgtggcacaggcaggcgccggtctgtgggtcgcagcgcgacgtggcgctgcagtagcacgcgctggcgcactgcgcgccccaccagccgggctcacagcggcacgcgccgctccgcgggtggcacgtgccgtgctggcactggcacgcatgctcgcagcgcgcgccccagcgccgcgcgtgacaagtacactggcctgtcacgtcctcgcactgcccgtgtgggtggcagctacacagctccttgcagtcggggccccagaactggcgcgggcactctgcaggggaggagcggagggggtggaaggccccggtgcttgagtaggtgcccccagccagccggaacctgcccgcgtcccgcactccagccgccacctctggggacccgccccgaaggcggatccgaccccgccccaccttggaccccgccccatctctccaggattccgccccaccgaccaataccggcccgaccccacgctcactggtgtcgcagttggcaccgaagtagccgtggcggcagcggcactcgccaggcctcacgcacacctcgttctctgagcacgtggagttgccttcgcacaccgctgtggacgagacaggccagagctgctgcgcgtcctagccccgccccctcccccgccccaggtccccgggatgacccactcaccaatcccacactcgtccccttgctgcctccagccagcgcagcacgtgggcacctgggagctgcgagcagagggaggacatctaagcccgatgcccctcccccagcccccatctgctccgggctcctccgcagcctccgcacagcctccctgcctctgcagttgcgctcctgtcctaggggggtggttaatgaggtcctgccaggcagtcgtctggcggtggaggattgccacaaacagacctcaccgccaagaactttccagcccagaaccacccaccccatctcacctaactcctttgtgtcctcctcccacagccattaggcctgagaaaagtggccttggagtcccaggaaggacagcagtgaggcagcagccagggagaagaccatgggcctcaggacctgcccaaatgtgagggtctagggcatccctccaagtggagggcccagcctaatgggtgtcatggatccagatgtcatgtgatgtgacatgatgaggacggcactaggactagctgggccacagggacacacctagatgcccagttggggttgagctccagtggggaggggcagcctctggacagggggacggggggtggcatgtagacacagtgaggtgaccacttggcagaggggcttctggagggaggtggggtgaggcccacccagccactagggaaggagcaggcacatggggagtcctccacgtgcaggaggaaagtcaaactgtggcaaaagggctcagggaccagggtggaggaaggagctattagagcatctgtttatgcctttgttgttggttttgaaacagtctcgctctgttgcccaggctggagtgcagtggcacgatctcggctcactgcaacttccacctcccaggttcaagcaattctcctgcctcaaacctctcaagtagctggaattacaggcacgtgccaccacacatggctaatttttgtatttttactagagacagggtttcgccatgttggccaggctggtcttgaactctgacctcaggtgatccgcccgcctcggcctcccaaagtgctgggattacaggcatgagccagcgtgcccggcctgtttatgctgattgtcttccacttgttccatttgatttggctttacagagtacacaatgctaccgcagcacttcaggagagcacaacctctaaaaccctgggtggatggggtgtgtgagcacaaaggtttggaggccctgcctgagtgaagccatgatggctagagagggttcgtaggggatgagctggggttagcccacattcaggggcagaggaggctgagaaggaagagccaccaaggctgcgggatcctaggttcccagccgacccagaacttcgcctcgatcctaaaggcatgtaacagccattcgcactttagagaaaaggagcacgcttcttcacaagcaggcttggattcagtatctgaatctagaaccggaaggtggtggggggcggagtttgggaggaagcctgaagaccctagcgggatgggatagactggccctacaccatgcatttcaggatagtacatgcctggcatgctcctgcccaggcttccgaggatgccccagccattccccagctagacagaataccaccccttgtacagagcacctaggcctcgaggcccctcctcctgaacaaggcttggttctccttcaggccaaagatgggacctggcgaacaggaccataaaatctcaaactttggggaattggtccagtgtattttccacaataaaactggaaaccagagacaggaatacaaaggcctggcttttcctggcccctgcccccactgtctccacccacccagccctgacccagggggcaccaaggtgcccatctgcagggagacccaggtctgctggccatcacccacccacttgtgtctgcttctgaaccatgttcactggatggagagcctctgcaggtgtccctcctgtggggagctttgccaggtggcctgctggaattgccccggaagcactaacccccttctgccctggacataaggctctgtggctaggaccctcgttttagggccacactcagctgggtttgatgtctgggtttgccacttgctgtgtgacctcaggcatgcagcttaagctctttgagcttcaggctccttagctatatagtagggctctactgtagaaagattaagagagccaagatgtttttttgccgggcgtgctggcatgtacctataatcccagctactcaggaagctgaggcaagaggattgcttgagcccaaggagtttgaggctgcagtgagctgtgatggcaccactgctctccagcctgggcaacagagtgaaaccctgtctcaaaaagagagatagagataggagagagagagagacagagaaagacgacagagagaaagagagcgcgcgccaagacctatgaagtggtttggcacatactaagcacaaaggatcctgagcacaggctgcagtgcctctgagtgcactcggtcatctctggtttagcgggcacccaggcctaaccccagcagagctaatgcccaccagcaggacagagtccatttgggttcactgagaacaagatgctttccttcttggaagggctggcagaaaaggccgggtggtggtggcaagcccactctctgaagatcttacaaagacgggtggggaaagatggcctgctgcagggctgctcccacgcttgccctgtaagtcggcaagaccctcagaagccaggccataggctgggcccaggcccctcagcaagcaagacatgccgtaggcttctccctcgtagagcattagttctgtgattcaaacccactgtgagttcttacatcttcaagttggctcatggggtccatacctgtccatgttctcccccaaatccaggcagaaaagcttctctgcctgccacacccttcagaccccacaccagcccgaccctcctgctgccccgcctggacacctctcctctggtttctgtccccatcctcagatctctcttgtgtccacactagctccctcgggaagctcactgaacactgacaacaccttggaccctccagcagggctctccccatcaatgctagacttgcaaatccaactgcccaatagatgatgtcaccagaaggagacctcatgggcctcatgcccaaccagcccaaacctgaactcttgacctccttgcaccctgagtcttccctgcctcagataaccctgcctgtcctttcaggctgggaagctgagacctggagaagcatctctgactcttctttcttgtctacaccagatccattgagaaaaaagacgctgagctctagcttctaaacgatatctaaaatgggatcacttcctccttccctatcccagccttgtgagagccaccctccatctccctggctttttgtaactggccccagcttccaccccctgccccccagggtgcgaagtgtttgccacctggcagccaatcctggtcagatcccaccctttctctgtacaaagcccccagggggtcccatggccctcagaagaaaagcccaagtcttctgagcagtggcagcccacggtggcctgcccaccctcactctctggcagctcctccgccagcccctcctggactctgcccagcctcctggatccttcctgtacttccacaggccctctgccttgggaaccttgccccagacacccacagggcctccgtgctcttctgcaggcctgtgctcactcaccaccttctcagccgttctcctcagaacaccctaaaggaaacagcactccccaacccaacacctcccagctcttgctagatgtctagacacacttgcttttctggactgtgtctcctctgccacagggtcagggtctccactgcagcttccctacaccaatacaggcctggcacagtgtaggtgcataggattttactggctttgcactctcctctccccatcctcctgcctcccaggaaagggaagggctgatggaagccttgcaagatgtgggaggacaacaaagacatgacccagaccccaggtgggcagtgcccagagtggctgtccttcccatcgacccttgccactcatgaccacagcgatctccacttagccccatgagggggttgtgatcactatcccattttacagaggtggagacaggcccagagaggtcaaatgacttgcccaggtccacacagctgggtagggtggcaccaggatgggaacccaaacccaggctcggttcctggagcaggcgcctcctgggaggtctgcagaccaggggagcgggagcaaagggctctcaggctccggacagctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgccgagccgggcaggaaattccacatcggctccctgatcccgggccagccgcggccggccaggcggcagcgcccgccccgcgctccagaccccaccctccggcctagccaccgcccctccgcgcagcccccgcccccatttggccgctcgcaaacttgggggcgaacttggaggaggcccgccgagcgctggtggagggagggtccgcccgaggaatccccggttcccgcgcctttccctccgctccctagacatctaccgaagcagccgcccctgcgcgcccactgcgtaggccaggcccgggacgggaaggcggatcggggacacggacgcgactccgcaagcccacccccgctcccagcgcctcggaaccggccaagggagtggggcccgcagacagcccaggtcgaggccgaaagccaactccacagcaccccaccgcgaagtccttgtagtgctggggtgtgcggtcagctccccctgcgcactcctgcgcactcagagctcgcaaggggcggaccgagcaggatgcttgaggcctgtggtagactcggtccggaccagaggcctgggggaaggggtctccgtagggacggatgggagagatacagaggaagtagaatggccaggctgtggactgcggtaggaagtagaggtaaagacagaaggagacccccgggatggaaaccctgcagtcctagttgaggagtgaagggggctgggggagcctgggcggtggattctgctggctgtcggatttccaggagaggctggggctagagagtgggaactcctgcatcaggtaaggtgggtaacagcacagagcagaaggaaggtgtgggaagggagcaagacagagggacaggccctagggagccagcggggaagctggacttggactgggaggcagcagggtgcgggtccccggggggcaactggggcagaccgactctggaagttgggcagggagcacaaatgtcccgtgtgtagccaggtcctagtgaggatgtttgtcttttggggacttgagagctggcagaaggcctaagcagggagcgggcacctccgttctttggggagcaggccacatgcggcccacaggctcactgagggagggcaggcagactctgtccaggtgtggccagatagccccgaagggtggggctggaggagggggcttggaggaggagccactgaaaggcccaaggccatgggcatcaccaggctggcacaggcagagagtgggatggggaggagcaggcccctcactcagccatgctggtgcaggagggaggtggggtgggctgaaagagaagtggaactagtgtggacacgaatgcaactacctggggacaaataaacaggccaaccacttctgggcagctcagcctgggcacagccctgacctcagcaatgccctcccagtgctggggcccctcccacggaggatccggattgcggctcccaatagaggccagcagaggtcccagtggctgcaaggtctgtcccagcccagctcctggctttagaggcactgaccccctgggctggaggggacactcacctcagctggatggaggtcatgaataggcatatcaaattccatcacctttctccttcccccagacctgtccagggagggcaccacctggatggtgccccccaatcccccaggacctcctaaatgtcttagatctctgcccacccctgtctgccacccagagtagtctttttaatctcacatgtggctatccaccactgctctcaggatgaggaccatccccagtctcacctcacgacccggtacatacatcccttgcagtagatggcaactttgggtgtcatgggcagagccctcatttctcccaaccaccactgcacccctaggggaagactgagaagtatgggaggaatgaaggatcatccacatggcactaggatgtagaaggaacccacagacaattgaccaccacgcaggcaaactgctggagcccggagccctggcctgctggttttggccaggatggctgccagaaggaagtggactttgaaggctgaggagggttttgcatgaaagcagggaccaagagcctagccacactggagagcacaagttgggctgcctcagctccggggtatcaggtgtaacccttagaaacccagcttagccccaaggctgacagtggcagggccaggctgcgcccaactccaaggcactctccacccctccccaggctgtgcaggacctcagtgagcccttcctgcccctgcagaccagaggcctcctgcaaacctgtggctgtggctggtggctcaggtgagatgttgccagccagcatgttgtcaggacgcactggagagtggtggggcatgtctggtgctcctcctttccagaaacctctgaggtctgcaggagctattgccctggcctgccaggtggtagcagagacacaggaagtgctgggtctgagacccacagagtggggttcctactctgaacccatgctcttgcgcctcaccctcaggagaaagggagatgacactggagtgtatagccatcccgccccactagggctcaacactgggtctgccaccccaaggcaatgtcatgtttcctcaggggtactcagggcccaggacagtgaggaaggtcttcaggttacacacacacccacataccacagccctgggggcacaggccaactctgagggctttgtctctaccctcaagaatccttggggtatccatttaggagagcccagagtgactgatagtcccccgtccccatcccctctcctcccatcaaggagcacacactgcccccttctcttccgggacaggatgccagcaggaacacatggctgtccccatgctctgcccagtcaactgggaaaggatggggccttggcaagttacagccctgtctgcgggatggctctgggcacaaggctcatagtaggagtctgcaggtgcagaccctatgagggcatcaggatggaagaaagcttcgtgtggtgcagccctgcagtgaggctggtgtgggctcacagcccatccatgcagggtgcaggctaagcctggcagtctcaagagggcaagaaaagcatggggacaggtgaacaggggagggtcccagctgctgtgccagtgtggtccttgagactgggtgcctaagggttacctggcaaacctgtagcacatgcagctcccctccccagcacactcagcttcaggaggttgggaggagccgggcacaggccagaggggccccccccaccgaccccctgatgctgccccgctcccaggtgctgaagctctggttccctgaccctcaggctgagagactcctaacgagctgggctgaaactctgcgtgctgccctggttgggagacaagttccacaccagagaagacactcaagtggctgcacaaccacctgtcaccagaccagggcgagttccagctttcccactgagtgccctgttagcttgtggagtttactgtgcttccctctcaggcagggtcttcccagtgccacttggcttctggcctgggcttccacagcctctcccagatggcagctctgaccccagaagccacgcttcctggggacgcagcttgggtgcactgtggaaaggaactgaggctgtggctacagaaaaacagttaacaccttctgtaagatgctttatttcattgaccaacaacatggggtctgaaaacccagcgggaggggtctttttatcacagagccagtcccaggcgagctgatgcatctctgctcctctgcccctcaggagctctcatcctccaaccccagctgcccccacagccccaccccattcacagaaagagggctaccacgtgcctcagcccccctgcccaggctgccagctcccaggtccttttggagaaggactgatctaggcagggaggagagaaggccaacccctccagggctcactgaggaaggccaaagcctttcagaagcagttcctgcagtgacgtaatccacagcctgggatctgcatggccctgagatgcctgcggcaggctggccaaggggctggtgtgaagaaagagggcagggcccataagctgtggccaacaggggcaggggccctgcctggagtaaagtgctctggcctaggctgcgtgggtttcactgccctgcagccccagcctcccttccctctgatgccaggcacagggagcctagtcctcactggagttgtcaaactcctcccagtcagacacactcatcacctcagaggcaaagtccgggtcggcctggctgcggtcaggggtcccgcggggcggctcaaggagcagggagcggggcagggtgagcacacaggccgccaggcctgagatggagttgtccagctggggcccttcctcccagcagtccttctccacatcgtaaatgtgcacgtagcctgtgcggctgccgcggttgtgtgagcggccacctaacacatagatcctgttgtccagcacagcaatgccaggctcaccgtgcccagcagggagtgggcagacagatgaccactgtccagacgtgcagctgtagcaggccacctgcaaagccaaggctagaataaagcccagcacccactgggacgaggctgccagctcccccacaagcccactgaccaaggtggcaacagttacccaccattctgacaggtcaggccccctggaaggatggcacagggccagtgttgaaacatcctgtccatgggccaggctgctgctttctcacccagggatggccgagtctgcaggaggctgtcttttgggccctcccctagaatgatcctattctctctggctttgctccagcccagcccttcctctaggccacccggccctaagccagtctctgcccccgagtgtgtggctgtgcccccatcagcatgtggtcattccccatgtctgagggcactgcttctctcccctccaggaaacgaagctgcctgagagacatggactccactgaaatgtcttcaacctccttctgcagcactcaacacaggcagtaggacagggggaggagacagaaagtggaagtaattccttgcggagtagtcaacatcaatattctcttgtcttcaaaattgtccaaacagtaaacaaagacatggaaaaatgttcaacctactagtaattcaagaaacgcaaaatcaaaacatcagagacaaatttttcaactagcaaccactgcagagaaggaaaatcacaaaacccaatgctgttgagggtgtggtaaagccatactactatgtatctgtctgacatgccagaaaaggaatttggcaataagtattaagagccataaaaatcttaccttcttgactgattagccgtttttggttctctagctatggtgggcagaatagtggcccccaaagatgtctagttcctaatctccagaatatgctaccttaagcagccaaaggggctttgcagataggatcaagggtacaagaatacaaaaaaaaaaaggattaagggtgcagaccctgagatggggcagttttcctggattttccaggtgatccatccaattgcatgagcccttaaaagtggaaggggagaggccgggcgtggtggctcacgcctgtaatcccagcactttgggaggccaaggcgggctgatcacaaggtcaagagatcaagaccatcctggccaacatggtgaaacctcgtctctactaaaaatacaaaaatcagctgggcatggtggcacatgcctgtaaccccagctactcgggaggctgaggcaggagaatcacttgaacccaggaggcaaagggtgcagtgagccaagagcaccactgcactccagcctggcgacagagcgagactctgtctcaaacaaacaaacaaaaaaagtggaaggggaggccgggggtggtggctcacgcctgtaatcctagcactttgggaggctgaggtgcgtggatcacctgaggtcaggagtttgagaccagcctggccgacatggcaaaaccccgtctctactaaaaatagaaaaattagctaggtgtggtggcgaacacctgtagtcctcctagctactccggaggctgaagcaggagaatcgcttaaacccaggaggcagaggttgcagtgagctgagactgcaccagtgccccccagcctgggtgacaaagcaagactccatctcataaaaaaaaaaaaaagaaaaaaaggaagggtaaagccagacaagagagctgagaagtgaggaggactcaacctgccattgctggctttgaagacgaagtgtccccaagccaggaaaagtggggacctctagaagccaagaaggccctcaactgacagctagcaaggaaatgggactgcaactgccagggactgaattcttctaaccagagtgagcagggaggcagatccccactagggtctccacaaaggaaagatgccctgaccgcaccctggttttagcctggcaaggcccatgtcagaggacttatgaatgcagaataaatttatcttaagttgctatgtttgtggtgataggttactgaagcaatagaaaactaatgtgctggcccagaggatctcacaagcagaggacctgttaaaagccagatcgccaagacccaccctcagggcttccgaatcagtgggtctgaggtgcctcgtaacacagcgttcccaggtgatgcagactctgttagtctgagaatcacactttgagaactgttgcatgaacctaaggaaataatccaaaatacctgaaaagctcaacaaagcaactattacttgtcatgttatttggaatagttaaaacttagacacaagaggggatgatgaagattgagtgttaatctggaaaatgcccaggacaaaagtcactgagagaagcagaatgggatatgggatgctcttttttgtttgtttgtttgtttgtttgagacaaggtctcgctctgttgcccaggctggagtgcagtggcaccatcacggttcactgcagcctcaacctcctgggctcagttgattctccctcagcctcccaagtagctgggaccacaggtgcaagccaccatgcctggctaatttttttttgtatttttagtagagatggagtttcaccatgttgcccaggctggtatcagttcctggactcaagccatccacctgccttggcttcccaaaatgcagggattacgggtgtgagccactgtgcccagctcagaatgggatgctctttgactacaatcaggcagaaaacatacacggtcaatgctgaaaatggtcatactgaaaaacagtactgcaggggcctgattatgaatgcttttcctcacccttctctattttttttttttttttgagatggagtcttgctctgttgcccaggctggagtgcagtcgtgtgatctcagctcactgcaacctctgcctcccgggttccagcgattctcctgcctcagtcttcccaagtaactgggattacaggcgcccatcaccgcacctggctaatttttgtatttttagtagagatggagtttcaccatcttggccaagctggtcttgaactcctgacctcgtgatccacctgcctcaacctcccaaagtgctgggattacaggcgtgagccaccgcgcccggccacccatctctattttttaaagttccggcaatgtggttatattaactttataataaaagttttgttctgttgttttgttttattttgttttgaatagagacagggtctcattctgtcacctaggctggggaacagcggtgtgatcatagctcagtgaagcctccaactctgggctgaaacaatcctcccacttcagcctcctgagtagctgggactacaggtatgtgctgccagcctggatctaaaagttttgttgttgtttttttttgttttttttgagacaaggcctggctctgtcgcccaggctggagtgcagtggcgtgatctcagcttactgaaacctctgcctcctgggctcaagccatcccccaacctcagcctcccaagtagctgagagtacaggcatgcaaccacacctggctaatttttgtatttttgtagagatggggttttgccatgatgcccaggctggtctcaagctcctgagctcaagtgatcctctcgccttggcttcccaaactgcttggattacaggcatgtgccaccacatccggcctaaaagtttttaagagtaataagcaaaggtagatgtgtatgtgtgtgatactgtcatggtgacatttgtccaaacctatagaatgtgccaagagtgaacactgtggactctggttgatggtgatgcatcaatgcagtttcaacaactgtgacacatccacccctctggagcgagaggtctgcagtggggaggctatatgtgtatggggggaaaagggggtgtatggaaactgtaccttccacttaattttgctgtgaacctaaaactgctctaaaaaatagtctatttttaaaaggcacatgattcaattacattttccatcaataacaactgagaggcttgggaatgatgacgggtgtggactgccccgggccccactcacctggtgcacgtccctcctgtatccggcatcgttgttgctgcccccgatcacatacagcttgttgaggagggttgccatgccgtgccaggcgcgccgcacaggcccatcagccagtgtgtgccaagtgttgctgcctggatcgtagcagtgtgtctctttcaggtaatcctcccctctgcggccgcaggtgatatacatcttcccctccagcgtcgcgcctgcgtgggcatacacctgtgtggagccaccaggagaaatggcgtgagagggcagtgaggaagggtggctgggtactctgtcaaggccaatcaccaccccacacctgcctgacaacgctgtgaggcttcaccacttcccactcacatacagacaagaatcctccctcgattctcatgggacatactgtcctagtcattgacctctaacctcttcccaatagcggatacatctatagactcagaaatgaaatgtagcctttgtctttcctttgctcctaaagttaacatctgcatgggggaactccaagaaaataaaagcattttttccaagccagtctggaagaagccacagaaccctggggaccgctgacccaccctcagtggcctccacccctcccccactcccactggacatgcaatcctccgggcctgctgaccctgcttttaaaatgtttgtaaataatatctgacactaaactcatgatgtggggagaaaaatacacatggttcttgattctggtcctgaaccttctgtgggctttttaccctccctctgttgggctatctccatagggcccagcctgcccccatcatgggcacctcttaccctggccctaccacttccggaacccacccactcacacccagcaggccaacagaaggccccaaggcaaggccctgggtgttttgagggtagaggagcccctcagggtgtggaggctccagagctatgttactgggcaagtcactaacactgaggccatgcgggtggcaaaaacacaagagtctagagaggtggacggagcagtggggaggaagaacacacaccaagggtttggtttgggtcttctcctatcaccagtaggggtctggggaggtttttctttttttttttttttttgagacggagtctcgctctgtcaccaggccggagtgcagtggcacgatctcggctcactgcaatctccgcctcccgggttcgaatgattctcctgcctcagcttcccgagtagctgggattataggcgcccgccaccatacccagctaacttttgtatttttaatagagacagggtttcaccatgttggccaggatggtctcgatctcctgacctcgtgacccacctgcctcggccttccaaagtgctaggattataggcatgagccaccacgcccagccgaggtttttctttttaattaaacttttcattttgagataagtgtagtcacgtgtagttggaagtaaaaatacagaggtctcacgtgccttctttcccccatggtaggagcctgtgtcactatatcacagggtcaccaggatgctgacgtggacacagccacagaactgtcctatcaccaccaggatcccgaggggctgccctttagggtgacatccactcacctcccttaccctaatcccttccttaagccctggaaaccaccaatctcttctctatttctacagttttgtaacttcaagagtgttgtctgaattaaatcagtatacaaccttttgacattggctttctaccccaacccaggttctaccaggttgttgcatgtacaggttgagtacctccaaaatctgagactttttgagcacaaacacggcactcaaaggaaatgcatttcagacttttggataagaaatgctgaaccagtaactataatgcaaagattccaaaatctgaaaaaatctgaaatccaaaacacttctggtccccagcatttcagataaagggtactcaacatgtaccaatagttggttccttttctattgctcagtagtattccatgggtatctaccacagcttgtttaaccattcactgttgaaaacacctgatttgtttccagtttctggctattaccaataaagctactattaacattcatgtacagataagttattttttatttttttgagacagggtcttggtctattgcccatgctggaatatagtggcacaatcttggctcactgcaacctctgcctcccgggttcaagcaattcttgtgcctcagcctccggagtagctgggattacaggcacgcatcaccatgcctggctaacgtatacagagtagttttcatttctctgggataaatacccaggatggtaactgccagatctgttttccagagtggctgtaccatttcacattcctatcagcaatccatgagcatagtttccctgcacagtcaccagtatttcgtattttcactactttttattttagtcatcctgaggtagttctctcactgtggctttaatttgcatttccctgatagctaataatgttacatatctccttatatgcttatttgccatctatacatcctcttcagtgaaatgtttcttcaactcttttgccttctgttttttgttttgttttgttttgttttgtttgtttttttttgagacagagtcttgccgtgtcgcccaggctggagtgcagtggcacaatctcagctcactgcaccctctgcctcctgggttcacaccattctcctgcctcagcctcccaagtagctgggactatagacgtccgccaccacatccagctaattttttgtatttttagtagagatggggtttcaccgtgttagccaggatggtctcaatctcctgacctcgtgatccacccaccttggcctcccaaagtgctgggattacaggtgtgagccaccgtgcccggcttcttttgccctctttttaatggggttatttgcagtattttgccaaggttttttgtttttgagatggagtctcactctgtcgcccaggctggagtgcaaaggcacggtctcggctcactgcaacctctgcctcccaggttcaagcaattctcctgcctcagcctcccaagtagctgggattacaggcgtgtgccaccgcgcccaactaatttttgtagttttagtagagatggggtttcaccatgttggccaggctggtctctggtctcgaactcctgacctcgtgatccgctcacttcagcctttcaaagtgctgggattacaggtgtgagccaccacacctggccgtttattgagttttaagagttgtttatatatgtatttatttaatactagtcctttgtcagataggtggtttgcaaatattttttaattttgatgaagtccagcttatcaatttttctttttatggctcatgcttttggggtcaagtctaagaattccttgcctagccctagctagatcctcaagattttcttctggtcatcacgtcgcgtggccgcagggagcagacccggacagctccagagcctccgggccggggcggcggcggcgacgcttcggctcctcctgagccacctgctggacccgcaccccactccatccccacaggctggggacaggccctggcgcggctgtgtgggatcagaagcagagttgcagaatccaaggacctatttttgttctttctccgcactgctttatgggaggcattatggcccccaaagacataatgacaaatactcatgctaaatcaatcctcagttcaatgaactccgttgggaagagcaataccttctgtgatgtgacattgagtagagcagaaagactttcctgcccatgagattgtgctggctgcctgtagtgattacttctgtgccatgttcactagtgacctttatagaaggggaaaccctatgttgacatccaaggtttgactgcctctaccatggaaattttattggactttgtgtacacggaaacagtacatgtgacatggagaatgtacaggaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgacacaagcagctgaggtttttagccagaagaattttcctgaagtggtacagcatgaagagttcattcttctgaggcaaggagaggtggaaaagctaatcaagtgcgatgaaattcaggtggatcctgaagaaccagtctttgaggctgtcatcagttgggtgaagcatgccaagaaagagcagaaagactccttgcccagcctgctacagtatatgcagatgcccctgctaaccctcaggtatatcacagatgtaatagatgctgagcctttcatccactatggtttacaatgcagggatctggttgatgaagcaaagaagtttcatctgaggcctgaacttcagagtcagatgcagggacccaggacaagggctcgcctaggagccaatgaagtgcttttggtggctgggggcttcggaagccagcagtctcccatcgatgcagtagagaaatatgaccccaagactcaggagtggagctttttgccaagcatcacttgtaagagatgttatgtggcctcagtgtccctacatgaccagatctacgtcattggtggctgtgatggtcgttccagccttagttcagtggaatgtctagactacacagcagatgaggatggggtctggtattctgtggcccctatgaatgtctgatgaggtcttgctggagccaccaccctgggagatttgatctatgtctctggaggctttgatggaagcaggcgtcacaccagtatggagcggtatgatccaaacattgaccagaggagcatgctgggagatatgcagacagcccgggaaggtgccggactcgtagtggccagtggagtgatccactgtctaggaggatatgacggcttgaatatcttaaattcagttgagaaatatgaccctcatacaggacactggactaatgttacaccaatggccaccaagcgttctggtgcaggagtagccctgctgaatgaccgtatttatgtggtggggagatttgatggtacagcccacctttcttccgttgaagcatacaacattcgcactgattcccggacaactgccaccagtatgaccactccacgatgctatgtaggggccacagtgcttcgggggagactctatgcaattgcaggatatgaaggtaagtccctgctaagtagcattgaatgttacaaccctatcatcaacagctgggaagtcgtgacatccatgggaacccagcgctgtgatgctggtgtgtgtgttctccacaagaagtgaccattgttggagcaccatccagagctagtgaccagtccagtggacagttagtgggagaatcaagaatcctttctagaatgtctgtttctcactatgtgcacagggtgattacaggcaccagtgcagtgatgattgtacttatttgacacatactccccctcgtcctggttgttgttcctgagaagggtgggtaacagatactccagggaaaagaatgcacattgaatggatgtgagagaccacattacctctcccactactttggggagcactttcctgtcatttctaacttaccacgtgcttggtgtactatatgtatgttgtgcctcatatgttgcaaagaactaaggtgagtatagcctactagatgtgagcaatatccagcctagatgattggaaagataccaatttaagtaaacttggtaaaatccaagtcttttttttttccaggaacaaatacattttctaatctacaggtagctaggggcaacacagttccattctaaagggaaacaaaagggagagccccacaaaactttgggggcaagggagagatactcatctgacacttcttttggaggtcagggtttgtatatcagaattgaagttagaatcagtgaattaaactgaatttgatggaatgtgagtgaacctagaacagcactgaagtattacataacctggaagactgagaagggtatattctttgaatgatctttttatttccccaaggtctttcacactggagacagcataaaagagtgaaccaatgttgggatgagagaagatgacataaatgtgggagttcagtataactggggataaactagaagtacctgtgattttacagtcatcttattgcctgccaggggtcatctagccatggcagtgttaaccttgaatgggggtgaaagcctttctttgttgaatcaaatactactacactattacacttccacactatttatttggggatggactgggagtgacagtagcctagtagttcagctacctgattactgccccattcttttagaagcacacttctgccaaggagtggtttgtactgctgtgattggtacatttagtcttttttctgctataagttttccttacctgtcctttagtgtagattttattcattacaggacagaataatcaaggacaaccaaaatccttttgttagtttcagtacctcagctatcaacatttctgagctatcattcaatgttcctctgtgtcatggagtgaaattcttgttttatgggtattgggagtgtgggaatgtgataacctaaacaacctttgctctgaaattccatttttccctctttccctgaagtgtactgacctgtactacagagttaatttcttttgtatttttttaagaaaatattaaaaatcaatggtctcaaaaaaaaaagattttcttcttctttttttctagaagttttatggttttacatttaactccataaaccattttgaattcattttggtatatggtatgagacttgggttgatatccatttttttgccgacgcatgtctaattgctccagtactatttgctgaaagatatctttcctccactcaattgtttctgcacctttgtccaaaatcatgtgtaacatgactgggcatatttactcaggtctgtgggttttccattctgtttcactgatctatgtgtctatcactgtatccataccacagccttgattactgtagctatgtagtaatcttgaaattgggcagactcctcccatcttatcgttctttttcaaaattatttgagctattctagttcctttgcctttatatatacatttcagaataatctcatttacatctaatgtcacaagtaaaatcaaatcaaaattaaaaaatttattttatttattttgaaatttattttattattattttttgagacagtctcactctgtcgcccaggctggagtgcagtggcgcaatctcggctcattgcaacctctgcctcctgggttcaatccattcttgtgcctcagcctccccagtagctgggattacaggtgtgtgccaccacacccagctaatatttgtatttttagtagagatggggtttcaccatgttggccaggctggtcttgaactcctgacctcaagcgatacaccatcctcggcctcccaaagtgctgggattacagacgtgagccactgcgaccagcaataaaaaaaaattttaggctggatgtgatggctcacttctctaatccctgcactttggccgaggcagacagatcccttgagaccaggggttcaagaacagcctgggcaatatggtgaaaccttcatgatactaaaaatataaatattagctgggcatggtggtgctcacctgtaatcccagctacttgggaggctgaggcaggaggatcacttgaaccagggaggcagaggttgcagtgagccggggtcatgccactgcactccagcctgggtgacagagcgagactctgtctcaaaaaaaataaaaataaaaaaatttttaaaaagcttattgtgcatgtaaaagaagagttcatgaaccaggaaaccccaaactggaagtggtatgaagccccaattcacagcagttacaacacagtttataaagcatgaatgaggaagaatattgttccctactgtgcatgtggagctgcataagctttctttgtaaagctatcacactgagggaggaaagcttaagtttcagttacatggctacaggcagttggcctaggggtatatccaaacctcagcttcaattttcattttcccttaatagtacaaaaaaccttcctgaaattttgataggaatactagtattcctgtattaatactatatcaatatgaggaattctgtattaatatatgtattattaattgggttgggaaagaactgacattcttactattcttactcttccaatccatggacttggtatgtctctccatctattcacatcttcttttatttctttcatcggctttttgtaatattcagtgtaccaatcctgtgaggttttttgtttgtttgttttgagacggagtcttggcagagtcttgctctgttgcccaggctggaatgcagtggtgtgatctcagctcactacaacctctgcctcccgggttcacgccattctcctgcctcagcctcctgagtagctgggactataggcgcctgccaccatgctcagctaatttttgtatttttagtagagatggggttttaccatgttggccaggctggtcttgaactcctgacctcaggtgatcccccccgcctgggcctcccaaagtgctgggattacagacgtgagccaccgcgccctgccaacatgacctatcctttttcattccccaacatctgatccatcagcaagcctgatcagtttacctccacgctacactctgaaccctcccatctccctccagctccacagctgtgtgccagcacaggctactgctgtcttcagcccagaccacgcaatgacccagggccagcctcgcttgctctgctcttgatccttgggcttccttcttctacaagcatgccccatgcttcctctcctgctcaggaaaagctgtgagcccctctcctgccctggaaggtccttctgctagactaggcagatggttagatatgagcagggaagtggactccaggttggcctcagcccctagcatggccagagggactatgacctctgagacatgttaaccacacctggggtttcaaaagtcccaacccctctttcagttaagcttatccagctcaagtaggaactaaccccacaaggaactttccacccccgggagcctgtgttgtatagtttgccccagttttgcttgcttcgaaagtaaccttttgttcactgcagtggtaaaaaacacacctcctgggtgaagatttaagatgctaatgagacatgcgataaatacactagcacgtagagccacagtgcatgcgctgctagaagaccacccaaacaaaacatgcttatgagtaacacctcttcccgcccatttatgaataatcatgtaagcctcctgtaagggaggtttcccatgccagttggggcgatcttattctggagcagcctgctctgactcggccttcagaatgtaccttcacttttgcaataaactgccttacacttatcttcgttaatgcatgtctcttgcttaaagtcttaaccaagaagacaagaaccgaggacacattcccagtaacatttcctccctctgtaaatggcaggtctaattgacatctcctcagatggacattccccaaaaagtccctctagattcatcctaccagagccccctccctggaaatcctccagttcagccccctcttcatttcacttaccataattgtaaccactttactgatctgttttctggttaagagtggtttctcctacaaggctgtaaacaccatggagtggggagtctttctcatttcttgtcaccactggattcccaggacttggtacatggtgcttagtagttgcggaatgaatgcgtgcatgaaggaacaccggcagccacgatgcagctggttgaaagccaaggctgcccctctgtggccaagctggagaactgctgcttccccagctgccgcagacaaagaaactgctaagcccctcccacaacacccacctaggaggcttcccccaacacccttcctggaacagaacccaagagccctccttgtccacttggtctcaaggacctcctgatcttctccatgcaaaatctgctcctttccccaggatgggggtacggagtgtccttccaaagaggcttccttctccccaaagaagctgagagcaaggagcaggccacagcttgcagctcacagctgcccaagagacagaaatctgtgtgggctgtgtgaatgacctggataaagaagagctggatccattgaggagacactagccctgacccctgaagtcaaagtctaagtccctgggggaattgggggtcatgagagatactggaaagaggcttacaaaggccagagctcttgctaaactccctgaggcagtgcaggtagaacctgccccccataccatcctctgcctctcaggtgctcggttatccccaaaggtgtacctggcccatagcaggtgctccacaaatgctatgccagtactagcggggtgccctgctagggtacccctagtactgctagggtatgccctgttctcggaggctgagacccaggaagtagggggccagcaaggcctgttccttccctgggatcccatgtctggttgttacaccaggcctgagtaccccaaagtcgtaagataaaagagaggcacctccctaaaacatcatttttccataatgaacataattttaaacatcttcaaattggaataaaccaaggtattatataggatgcacgtgatttttttttcaagttgtcccaatattcaaacataggatttaatataaaaaataaaaccttagagtgtttcttggctctggaaggcgccacccttcaggggacctagagggaagaggtctgaggataggccagtgagctctcagggtcccttcctgtttaacatctctggaagtgtcccagctcgtctcagctgcacaaagagcaaatgttctatccacatttgaactacaaggtttaagcagcttgccagggccaaggtggtgtgacaaggtctcagcatgtaagactcacaagtggggcacaattctgagcaatggggtctggatccttgatgagcctccccaggtggactggctgaacctcatggggcctcatcaatgcattcaatgcagggtctctggagaagcatggattctgctcactgagcctgtttctctgacctgggacaggccttgacacctaggcctctcactctttgcacatcctggggaaggaaattaggcaggagaaggcccctcttcgagggcttccttacctccctcttgagtggggccacgtatgcccaggagttggtggcagggtcgtagcgctccacagcattcaggtcattgtggtagtcacggcccgccacagcgtagatgtacctgcctacaacacacacggacaggtcggcgtgctcctgctgcagggactggatctggaaccagcggttgtgccgtgggtcatacctgtgccgagacatgaggaaagcacagcactgactaggcagggaggctgctccgcaggcttgcacctcttgttctggtcccatttctgctttgcctcagcccagcctgaaccctccccaactaccccacataccagtgcacaccgatctacagccaggcccacaggctgttacacacctgagcacaggtgctccccaccacacagcatggaaggaatggccaggagcctcctgtgtttccacctaactgtccacctgggctgtccaatggctctttttttttttttttttttttttttgtggagagaggtctctctgtcccctaggctgaagtgcagtggcacaatcatggctcactgtagcctcgacctcctgggcttaagtgatcctaccacctcagtctcctaagtagctgggactacaggtgcgcaccacaacgcccgctatttttttttttttttttttttttgatagagacaaggtcttgacacctgggatatggacttaggcaatcctcctgcctcagcctcaatggctgttcgtacagccacttccatctcacttacctcatctcatcatccacatagccttgctcccactcaggagggcctccaaatacagcctctccactggatgggtgccatcagccccctcattggcctccaagccttgaacttcccccagcactccatcaggagtggtcttctcaggcacgccctgcacacagcacccatcataccctcagctttgtcaacagccgcacacacaaggctctggtcatcgtactttcacctcctcccaccatgctgccagccccgcgtttcctgacctcccctccactcaaggtctccctctctgggaaagtggaaagggttaactcccaccctggactgcaggctctgtaagggcagggtgtgtgagattccagggacccccatgggagaaaaggcactagactggttgcggcaggcccacgagggtggaggagtctggccaggacccaaggagggctcctgggctgagcaccaacagggagcatggcctgcaatgtggagcagagatgatcacagagccatgaggggccaggacccagtgagctcaaagccagtatctgaagtgtccttgcccaacagcccacagatagttacagcctctttcagacaagtgtttttatttctgcagaggaagacctattccaaagagaacaagtctaacttcaactggctcacaagagagtaaccaaagttttctttggcctgtgccctatgctggttagtgaaaagatcagtttcatcctttgcttcctgcagcccctgcagtgtggccagcccctccccgccgcctaccaggaatgcagcaaacaggagcctcagaaggcagggccaacaagagagggaacacacacctgggtctccctgacctggtgtgaatcctgggctcttccctgtctagctgggtgtgcctgggcatcagttttaatctcttgggattcgctcagttctgcacctgtccaatgaggtgatatcacctgcctagaaaagctatcaagaagaatcataaaagacgagcatgaaaagtgtccttgttaacttgggggttctgatggatcatggttcatttctatattcctagacctcagtgtagcctctggctcaggacagattatgttctgtctgctgaatgaattaaacaaaggagtaagattaccagcaatgaatcattcattcactctaccaacattcccaggtctcccactgtggatggggcacagtgctcagcactacatccagagggagcctcaagaggtcagggccctgccttcccctgcagaatggaaacaggctaaccagagcaaatgagtgcttaatataatgacagacactgtgaaagaaagaaagggaggtaagaagatgagtgacctgctggtcagcggggcctggggagggcagagctcccttgcagtgatcaggaaaggcctcctgagaaggcagggtctgagacctgcatgacctggggcacaagccagaagaaggtctggcaggggaccagcagtccaggattggggcacagcactcacaggggccccgtcaactggctgggatggtgctgttcactgcctttcctgtgcgccttcctcctttatatacaagtctctcctctcttgtgttcagtctggctcaatcaccatctgcaccccaagtgtctgcaaccagagtgagataggaccctccatgtgctcctgtttgctccttcgagtctattgtcctcacagctttttaagctgagttcatgtggatttgtggcttcaaatttaaagacacacacagggccgggcgtggtggctcacgcctgtaatcccagaactttgggaggctgaggcgggtggatcacgaggtcaggagttcaagaccagactgtccaatatggtgaaaccccgtctccactaaaaatataaaaaaattagccaggcatggtggtgtgtggctgtagttccagctactcgggaggctgaggcaggagaatcacttgaacccgggaggcagaagttgcagtgagctgagatcatgccattgcactccagcctgggcgacagagtgaaactccatcccccaaaaaaaaaaaaaaaaaaaaaaaaaaaaaaaaaaaaagacaccaacagtgataccatatgtcaataatttagacatagccaaagttacactgatttcttatttccctgttgtgtcctgtatccctcttcttctttattgaattaattttctactttatgagaataagtcctcaagtaatatttttctaataaaaataagctttatttttgcatataaagatataaacaattttacttattgctatggactagatgtttggattcccccaaaacccctatgttgaaggcctaacccccattgtgatggtagtgggaggcatggcctttgggaggtgatcaggtcatgagggtggagccccatgatgggcttagtgcccgaggctacagctctttctctccaccatgtgagaacacagacggaaaggaccttaccgggactaaactggccaataccatgatcttggacttcccagtatccagacagtgagaaatagaggtatgttgtttaagtcactccatctatagtatttgttatagcagctgaaactgactaggagagtcactttaactcagatttgtatcatcctattgtaaactcagacatgaaccctagagttggtacaaaaatattctggaattcttgttaaattcattagactgtggccaggcacggtggctcacgcctgtaatcccagcactttgggaggctaaggcgggaggatcatgaggtcaggagatcaagaccatcctggctaacacggtgaaaccccgtctctactaaaaatacaaaaaattagccaggcgtggtggtgggcgcttgtagtcccacctactcgggaggctgaggcaggagaatggtgtgaacccaggaggtggagcttgcagtgagctgagatcacgccactgcactccagcctgggtgacagagagactccaactcaaaaaaaaaaaaaaaaaaaaaaaaattcagtagactgtttttcttctatatttccatgacttaagtattttcatgactattaatgttttaatgtctattaaattttttaaataaattaaatgtactgaccgggcacggtgggtggctcatgcctgtaatcccagcactttgggaggctgaggcaggcggatcacctgaagtcaggagttcaagaccaacttggtcaacatggtgaaactccatctctactaaaaatacaaaaaaatggccgggcgtggtggctcacacctgtaatcccagcactttgggaggcccaggtgggcagatcacctgaggtcaggagttcaagaccagcttggccaacatggtgaaaccctatctctactaaaaatacaaaattagccaggcatggtggcgtacaccggtaatctcagccactcgggaggctgaggcaggagaattgcttgaacctcagaggcggaggttgtggtgagccaagattgcaccattgcactccagcctgggcagaaaacagcgagactccatctcaaaacaaaaaaacaaaaaaacaaaaaaattagctgggcgtggtggtcggcgcctgtaatcccagctattcaggaggctgaggcaggagaatggcttgaacccgggaggcagaggttgcagtgagccgagatcgtgccactgcactccagcctgggcgacagaacgagactctgtctcaaaaaaaaaaaaaaaaaaattaaatttactttaaaatattagcagccatgaaatgccgaaggaaaaattacattattatttaaaaaattttttttagagacagggtctcactctgttgcccaggctacagtacaggggcatgatcatagttcaccgaagtctaaaactcctggactcaagcgatcctcctgcctcagccttccaagtagccagggctgcaagcacgtaccatcaggcccagctaattttttttttttttttttggtagagacgaggtctcgctttgttgcccaggctgatcttgaactcctgggctcaaaagatcctgctgcctcagcatcccaaagtgctgggattattgacatgatctgcacatagcctaaattattattttaagtagggtcagggcacatagcaacatgtaaccagctactactaggtataccatgtagttggtgttcagtaatccacagggctatggctatgggaaaggtacaaggaatgatgcagataatatagatgcaaagaaagaaggaatgaaagagaaaaagtagtatattggagacaaacaccatttgctccaagagaggaaaggtttttaaatatgcggtttctgcaccaatgctttaagatataacctggtaagtaataactcctcaaaatgcaaagcctaatttactgcaaaatcttgtttccttatattctaaaagcctatagcttttagaattcaccagttctaaggctgatgaaatgagaaagcagagaaagaaccaaatcttagaatattcaaattaaggattcatctggaagttttgagtccactggaaggttaatgatgccttcattctggagagatgatacatccctgggttaaccagtagggctgtggtccttcctgccacctccactctgtggatacctactctctcaaggcaggtcttgccgaccccacttgccattgtgatcctactctcagacaggagtttgggactggttattggttacagggtctaatattagcattacccagagttcagctttggtctcacaccccttcacaaggggaaattcagactcctactttaagtgaaagtgagatcaatggcccatagcaggtggacagaggacaggggcaggcagaatcccaagctgtcacccccctagggacagctctgtggaaacatccagcattactgccaagcacacagctgtctctaccttctgctaagggccagaagccaaaacactctggagagattggctttgcaggtctgtaggttactctcagcagggtggtctggccttggccccccaactgggaaaccgagccccctaaaaaagaaggtttaaggtttggccaaagggaagtctaaacctagtgtggccacacccactgggggcacaactttgtttagagaggaaatgaaggtagctgtttccttttttctgaaacctgcccttcctcatatttaaccacaatgtgttattgccaacctctgagtctcatcagcttaacaaaggagatcacttcctggggccagcagtagagaggtcgctgagaaatggccttctcctccttggccaggatcactatgcttgattccaagtggcatggccaggccaggccctaccccaccctgaccccagaaaatagaaacatgaacatgaactcagtcagcatctagctcatggctgctggaaatagttggcaatctctctctctccaacacagctccatctttcagcatgaagggtagggagatttctcacatgcaccaaggtaaggtggaggggtccctggaaatctaatggtagctgagtcttgtgggcctgaaccactgtcccttgctctgcccagaaatggatttgtgagatcacagcctaagtgactgatggagccaggcgcatcctacggaccacagcagtccacaaaactctctcttgggaaaactgcctcttcccaggggaaattgtgccaagtgcgtggcagactgcagggcagagcggaaatgtagcatgaggctcggtgatgcttgttggcctttaccacgcccctgggctgaagaccgcatgctgctcaggcacagcagcaggaagcctgttccaccattagcaagcaggtaagagagaagagcaaagctgactggtgaagggaaactgaaacaacatgcatcaaagctcagagagagcatgatggagggcgaggctgctcagctggcactgctcctaggtcctctccatcccagtccgactgcctttcctgctgtgggctcctctcccctcccgtctcctcctgcacaatgcactcgcaacctagcctaccccaaagaggctgagcaagggtccagggtaagtgggtttctgaggagtaggggacatgcaggaaagaaggcgatccacatgtccccttctcttatctcactgctgtccaccttctctgaattcacctagacttcattccacaatggcaagtgatgctcatgtgaaaggctggggggaacctgaccagctctctcagcccatgacttccacaccctctcatcacctgaagacaaagggaccagctagcaccctgtcctacctccagcatcgggactctgctcgaaatccttggacattgttgtcccctccaatcaagtatacgaagttgttgagcaccgcgatgccctggttggacatgcggggggccagggaggcagtgaagtgcttccactctcccagtaaggggtttagatacttggcctggtcgctgaggacagtggacggcgtggagtgaatgcccccgaagcccacaacgcactggaagtccgaccgcagctccgtttgcgggctctgcaggctgggctgtaggctctcgttccggtggtacatgagggcgctggccactgtgtccctcaaagggctggggtccagcttgtcatgcagccgctgcaggacctcagcttccatcagcggaaaccgcactgtctcaaggagctttgggggctcgtgcagcgagatctggtcagcctgcacctgctccaggctataatggtagagaagggccccctcatatacctcggtctcgcaggagacctccaggcgattgctgctgaggagggagtagaccttctccaatggaagctggcggtacttgtcagtccgagagaaggccacaaagtttttgaggatataggtgtccagttgctcagtcaggcggctcaagtcaaacagctctgccagccggtagacatcgagaatgttctcttcgtccacccaggacatgaggaaatcacagcagaaatggataatttctgggatctgcagagagaatgacacccattcaagcctgggctggtgaacagcatctgggggtgggagagagaatgatggcagaaatacgggctgttgtgggccaggcaaagcagaagggaagtcctccttaattgtccccgaccttttctgacacactggagactggggcttactgcagactaggtttaagtcctggtttggaaacatactgggtgacaggatatacagcatgtttttttttggttttgttttgcttttctttgagacaaagtttcgctcttgttgcccagaatggagtgcagtggcagaatctcggctcactaacacctccccctcccgggttgaaatgattctcctgcctcagcctcccgtacagaatgtttttaacctctctaagcctcagtctcctcatctataaaacggggatcattaaagtgaagaggaacatgatgaaaatgagagagcacataggagtggacccttgatatatgtcagttccctcttagatcaaaagtactggctcggccgggtgcggtggctcatgcctataatcccagcactttgggaggacaaggtgggtgtatcacgaggtcaggagtttgagaccagcctgaccaacatggtgaaacaccgtctctactagaaatacaaaaattagctgggcgtggtggcgcgcgcctgtaatcccagctactcaggaggctgaggcaggagaatcgctggaacccaggaggcggaggttgcagtgagccgagatcgcgccattgcactccaacctgggtgacagagcgagactccgtctaaaaaaaaaaaaaaaaaaaaaaaaagaagtactggctctccagaaaagcaggaagcagcacaaatggtcactgtgtcatatatctgtggtttggaaaggacctaagaccatccccatccctaccctaggattctctggaagagcctgcctctccaaaagcgctgggaccagaaacaaacctggctttttcccccgccagaacatccaccctggttccctagaagtgctcagagcctctcagacacctaaccaatacccacccaggaacctgatttagaattatttttcttttttctttttaaaatttgagacagggtcttgctctgttgcccaggctgcagtgccatggcaagatcatagctcaccgaagtctcaagcttctgggctcaagtgatccctgactcagggttcttgaggttcccagctgggtcaagacccacttgactccagtaagtgcaggggctcccaggtggccatatcaacccttcccagccatggggaagcactagtggtttgaaaggacggcaagagagagaatgacactggagggaggtgggaacaaggccacaaccagcaggctgttaaaggccaccctgtgaacagacaaccaaatcttgggagaataggagacaaagggaagggccctagggaaaactgcctgggagaacaaaccaggtgttgataaattatttaggaaagcaggattttagagtttcagtggggccccccagtgcccacctcctttctttccatgttcagattgaaaatgacgagtaccttgacctctctgtgacccagacagctgcaggttctcccagcaggcttgaacccaaaccaggcccttgaacattcccaggcactgataaaggcatcaaggttgttacccaaaacactgaaggaaaaactggttctggccctgagacaaattccttaaaccctcatagaaactccatacactaacccactctgtgggcaagcctgggtaaagcctctcttttcccttgtctgtcttgaggacatgctacatcactctatacataagttcccctaataaacgctctggccagatcaccctggtgtttgatgcttctttctttggaatcccaaaacggctccatttcaggatgctgtggggtcccctcttgtgggaacccccttgctaccaactccagccatgtgttcaatgcaataaatcagtttctctaaaaatgggaatacctggcttatccaggatcatcaataaattaaccattacacatggaataattctgctggtatttatgtatttatttatttattattttgagatggggtctcactctgttgcccaggctggagtgcagtggcacgatctcggctcactgcaagctccgcctcccgggttcacgccattctcccacctcagcctcccaagtagctgggacaacagacgcccgccaccacgcccggctaattttttgtatttttagtagagacggggtttcatcgtgttagccaggatggtctcgatctcctgacctcgtgatctgcccgcctaggcctcccaaagtgctgggattacaggcgtgagccacggcgcccggccaaggtatttaaagcttatcaataaacactaactataacttttttaaaattcaaaagacatctaatattgcttgcaaggtgacatgctaagagctggatgagacctaccaaatgtcaggcaggtatgtgccctacatgaggtatccccatggtgctttgctaggccctgaccagcttcacttgaccttcttttttccctttttgccagtcttctgctttgccacttcttcccaaactactaggttttcctaaaattctggtttgtcatgggccagggtcctgaagaccaagttttgggcagaatgtgagcacaaacagccctgaagaagcctgggcagcagcagctccttgagaggaccctgctgactctcctttcagtcctatttttagagcagtgggccttctgttcagtgaaatctcacagaggaaccagcctgggctcaggatgtgcaaaagccccatacgaggctcacagaagggactgcatttgcttggggtaacccaataggacagtgttactgggaatcagactcaggcctctggggacaccgtgaagaatctggtcccaggcctactgcagggcacaacacatgggggaagcctccaaaagtcactagctatgtgaacatacatgattctacaggcctatggacttgacatggttatgccaagtaaaacctgctataaaacaatattgtgaagaagcctgtttttttttgtttgtttgttttttgttttgagataagctggcatgtagtggtgtggtgatcacagcttactgaagcctccacctcctgggctcaagtgattctcccacctcagcctcccgagtagctggaactacaggtgcatgccaccatgcccggctatttttaaagtgcttctgtagaggtctcgctttgttgcccaggctgatctcaaactcctggcctcaagcaatcctctcaccttggcctccaaaagtgctgggattacaggcatgaacctccaagcctggcccagaagcctgatatgttaaaaaactaagataggctgctgcctctgagatgacctctgaggcactgggggagatgacccagggctgtcgggagcactggccaaaccaacagagagagactgcaggcctccaagctgactggtgagagagggaaagtgatgttagaaagatgatctggtttcagtgtgtgtgatcactgcagggagaagaaagaaatggcagaaacatacagatggaggccaggcaaaagggaaggaaatggaaacacagaacagagatggctacaagcaataccgagaaggatgacctgtcctcacatggacgcagggaattaagaaggtggacgggctcaaggagccactgaggttgagcccagggaactggcaggatggtcacaggacacacagagcagggggactgacaggggagctccgggagagtggcaggtgtggaggaggagataggacagctggacctgagccatgctgggggagatgtttcagaggcagctgaatcaggagttaactgctgccagggtggagaattggatgagggttcccaaagcaacaatgacagggatgtggggacagaagagatctctaaataaaagaacagggggaaattcttttgttgtaaaagccaactccatctactcaccatgcaggtatggtgagacaagtcagtcatctcagatcaacccacccagcatccaggtcctatccaccaatctgagaacagggcacagggaggctgccagggccctgtcacatggggtggcacctccacatgcccccgaacaggttggttttcctgtgacttgagttgtttttttttaattgcgtcaaacctgctctcatgggaagaaaggtcagaatgatgaacttagcatagcattttgtttcacttttaagaaatgtgggaagaggtgactgtcaactcctatcaggcctctgcctgatagctcaaaggcacctgcaggcccagtcccgtgtaactgcacccacaccactgagaataatcatccaaaacataagtcacactgtcaaagcctcagaaaactttttgaattctgcaggaaaacaagtacttaaagttcaataacaggttgggtacagaggctcacacctgtaatcccagaactttgggaagccaaggtgggagtatcacctgaggccaggagcttgagaccagcctgggcaacataacaaggccccattcctataaaaaaatatatatatatataatatcagctaggcacaatggcacgcatctttagtcccagctactcagaaggctgaggcgggaggaccacttgagcctaggaggtggaggctacagtgaactatgatcatgccattgcattacagcctgggtaacagagtgagaccctgtctttaaaaaaaaaaaaaaaataggccaggcgcagtggctcacacctgtaatcgcaacactttggaaggctgaggtggatcacttgaggccaggggttcaagactagcctaagcaacaaagcaagcctctatctctataaaaataatttaaaaattagccaggtgtagtggcacatgcctataggtcctagctatttgggaggctgaggcagaaggattgctggagcccaggaggttgaggctgcagtgagctgtgatcgtgccactgcactccagcctgggcaagagagagagagcttgtctccaataaattgaatgagtggatggatggatgggtggatggatggatggatggatggatggatggatgcatgcatggatggatggatggatggatggatgcctgccaccatggatggatgcatgcatggatggatggatagatggatggatggatggatggatggatggatggatggatggatgcatgcatgcatggatggatggatggatgcgtgcatgcatggatggatggatggatggacagacaaatagatagataaagttcagtaacaaaacacataagttttcaagagactgaagtggcccagtgaggggacaggcaggaagggccctggcagcaatgctggtggatgctccccattgccagaccccagagcacacaggacgtccacatgcagcctcgggtcagcctacctgcttatgtgcaggatgctttcaatgacagggagactcagacagtggggaaacaaccagcaatagagaagagggcaaaggcagaggcctggggtgtctagagcggctctgcttgagctccaggaacaactccagagtcttccccacttcatggccttcgtcactgcttggtctcctcacattcctgacccatcttcaagccaatgctagtgcccggcaggcatcatgggcatctcagggaaccccacctgggtgtgggtctgccttgctagatgagacatgcctcacctgaagctggcaggcagccaccagtgtctcttgtacattgctcaggctgagctccagctcggaggtgtatatgaaatgtaggatttggcacatagcattgtaggacacaccgtggatcaggacctcttcctgttccatctccttcaatcccccagcaaacattcctctgcaaagtgaagacacaagaaaatggagttataccaacagggacttaagcccatgttgccaagagtgacagcattcagagaagaacctggcgctggtggcagggccctggtagtgggctgacccactctgtgctctgagtgaactgtgtgcatgcatgagccatcccacaaaaggatcctgacgaagtctgggcagccatcctggaaattgtcctgtttcccttttcatgggcccaaggagtcccatgtgagcttcgggaggtgaggccacaagcagcttgcttctgctgtgttcatcagtgcagttcctggatcggagcagtagcaactccagagcacatttcaaagcaatgaattaattaatgggaaactaataaaagtcatttcattcaatgtatatttatggagttcctaccaaatgccaagtatcattcaaagagcagaaggaggccaggcacggtgactcacacctgtaatcccagcactttgggaggccaaggcaggcaaatcacttcaggtcaggaattcgagaccagcctggcccacatggtgaaaccgcgtctctactaaaaatacaaatattagccgggcatgatgttgtgcatctgtagtcccagctactttggtggctgcggcacaagaattgattgaacctgggagacggagggtgccatgagccaagattgcaccactgcactccagcctgggcaacaaagcaagactgtctcaaaaagcaaaacaaaacaaaaaacaaagagcaaaaggagttatagtgaagtaaactggtaaaatagctgggcgcggtggctcacgcctctaatcccaaccctctgggaggccaaggcaggcagatcccttgagcctaggagttcaagaccagcctaggcaacacggtgaaatcctgtctctacaaaaattacaaaaattggccgggcgtggtggctcacgcctataatctcagcactttgggagggcaaggcgggcagatcacctgaggtcaggagttcaagaccagcctggccaacatggtgaaaccccgtctctactaaaaatacaaaaattagctgggtgtggtggcgggcgcctatcatcccagctactcaggaggctgaggcaggagaatcgcttgaacccgggaggcggaggttgcagtgagccgagatcacaccactgcgatccagcctgggtgacacagcaagactctgtctcaaaaaacatatatacatatataaataaatgctaagaaggaacccagcagggcatctgacctgagagtcactggttagaagaggggtaggtggaatgatgagaaggagcagggaaagccccatctgaggaactgagacctaaggataaggctgagagggtgtaggcagccggggagggagttccaggtgaaggagacaggtgtacaagttctggggcaaggcagagcttggcatgcaaggcagccaagatgatgacgaagtgagcagaaagtgggatgggcaggcaggccttggagccaggtccccctacctctagggtaggtacagtccagattgaaatctgagcattatgggatgctcttgaggaatttacccacagagtgatgtgaactgactggctttccgactcaggtgctggaggaggagcccctggaagaccaattaggcctgagattcctgtgggcctggaggccaagggtgaccctggccctggggagggcattgcagctagaaagcagtagctgagactaccctgggacacggcacagagaacctactgacagactgaatctaggaggacctgggaggactcaaggccctctgctgggccgaagaggaccctttactgatggaagaaaatctggacagctgggagtcccgtgattgtgtgatcagtgtgagatacctgtgaaacctccaagtgtagacactgattaggtgtttggaggtaagaggctggcaactggggctgaagtttaaatatgacagcaacatgaagattataagagaagctatttttacattttatttatttttttgactaggtaatacatatacatgctaccagatttaaaatacagtataggttaggccgggcacagtggctcacgcctgtaatcccaggactttgggaggccgaggcaggccgatcatctgaggttgggagttcgacaccagcctgaccaacatggagaaaccccatctctaccaaaaatacaaaattagctggtcatggtggcacatgcctgtaatcccagctactcaggaggctgaggcaggagaattgcttgaacccaagaggcggaggttgcagtgggccaagatcgtgccattgcactccagcctgggcaacaagagtgaaactctgtcacacacacaaaaaaaatacagtataggttgtggtgaaagtccccttgcctctgctcccagaccatcagtcagttcccctcccagggccacactatcctcagggcagtcatattccacatctcacttggcttttttcttttttttgagacgaagtctcactctgttgcctgggctggagtgcagtggtgcgatcttggctcagtgcaacctccgcctcctgagttcaactgattctcctgccttggcctcccaagtagctgggactacaggtgccccccaccacgcccagctaattttttgtatttttagtagagaccgggtttcaccgtgttagccagaatggtcttgatctcctgacctcgtgatctgcctgcctcggcctcccaaagggctgggattacaggcgtgagccactgcacccagcccggtttttacttaacaatatagcttggagactgatccatgcccatgtacgcaagactgcctcactctttgcaaaggctgtctcactttttttattttattttatttttttaagatggagtttcgctcttgtcgcccaggctggagagcaatggtgcaatctcggctcactgcaacctccgcctcccgggttcaagcaattctccaaactcagcctcccgggtagctgggattacagtcctgcgccaccatgcccggctaatttttgtatttttagtagagatggggtttcaccacgttggccaggctggtctcaaactcctgacctcaggtgatccacccgcctcagcctcccacagtgctgggattacaggcatgagccaccgcgcccagccagctgtctcacttctttaacccatttctacaggggtatatttaggttacttgtaatttccagttatttcacatgatgaacatcctcacccttacaacatgctgagtatgcatatgccaggattaagtcccacaaatacagttgctgggtcgaagggtttacatacatttatactttgatagtattgtcaagttgctgtttttatatcattcctgatagcagggcctggtgcctgcaccctctacccccaacccaggaagacaccagctctaactcaccaccacaaaagggaaaaaccttatcacataaggtacagaaaatctccttatatgttaaagagccatttccattttcttttctgaacagttcagattcttagtcagttttctgttagactgtcttatcaatttgaagaaatctgccctttctttgatgaggagtttccccgatcttttgattttgtattgcttttttgccatgcagaaatttgtcttttttttttttttttttaaacaagtctagtcaactgcagtagtgagaaggtgaaaaagtagaacctggagttggatctgtgactgtgaacaatcaactgaggtaactcacactaccttcggaccaacctatcttcgttttcaatgttgtcaaatttaccatttacttgcctctgagttttgtgtcaaacttagaaaggctttttctttctgagattattcagaaaacatttccgatattttcctctagtgtttttattattgaatctttcacatttaaaactgttgatccacctgtaatttattttggtataaggtatgaagcaagggtccaactttgtttttctagatggcaactctgtcgtcttccctccttcctctaatttttttttttttttaagacgaagtctcactctgttgcccaagctggagtgcagcagcgcgatctcggctcaccacaacctccacttcccgggttcaggagattctcctgcctcccagcctcccgagtggctgggattacaggcatgtaccaccacacccggctaattttgtattttcagtagagatggggttatcactatgttggccaggctggtcttgaactcctgaccttgtaatccgcctgccttgggctcccaaagtgctgggattacaggcgtgagtcaccgcacccagccccttcctctaatttttgaggctatctttatcacataggacaggaatagtctcctttcgttacttttgttttcgacaatttcctggccactgctagctttttacatttgaattttagaatcaagtttctgtaattgccccaaataaaccctcttggtattttagggggttatgttaaacatctaggttaatgtagagataaatagcatttttataatggacacagtggatctttttaactgtccagccatcctctgggtccatttggaagtcttataagtcatcttcctacagatctggcacatatttgttacatttattcccagacatttcactccatgcatggccaagccctcggggcactttcccatgctctttacagtggtctgtctggctctcctggactttccaggactgtgctcgtgcatgtacttctgtctgattcttctgctggcacctctgggactatattggcagcagtggagatggcaacatttcaagcactgcccgccctgagcagggtgtgggtgcttggattgacacagatttttttttttttttttttttttttttgagacgaagtcttgctgttgcccaggctggagtgcagtggcgcgatctcggctcactgcaggttccgccccccggggttcacaccattctcctgcctcagcctcccgagtagctgggactacaggtgcccgccacgtcgcccggctaattttttgtatttttagtagagacggggtttcaccatgttagccaggatggtctcgatctcctgacctcatgatccgcccgcctcggcctcccaaagtgctggtattacaggcgtgagccaccacgcccggcctttttttttttttgtgacagagtctcgctcttgttgcccaggctggagtgcaatggcgcaatctcggctcactgcaacctccgcctaccacgttcaagcgattctcctgcctcagcctcccaagtagctggaattataggcatgtgccaccacgcctggctattttgtatttttagtagagacagggtttcaccatgttggtcagactggtctcgaactcctgacctgatgtgatccacccacctcggcctcccatagtgctggattacaggtgtgagccaccacgtctggccggacacaaacttttaccattttaagaaaaaaaaaaatcttataatcctttcgggggccaaggcaggaagactgcttgaggccaggactttaagattagactgggcagccaggcaccatggctcacacctgtaatcccagcactttgggaggccgaggtgggcagatcacttgaggccaagagttcgagaccagtctggccaacatggtgaaacctcatctctactaaaagtacaaaaattagctgcatggtggtgcacacctgtaatctcagctacttgggtggttgaggcatgagaatcacttgaacctgggaggcggaggttgcagtgagctgatatcgcaccactactctgtgacagagcaacactgtgcctcaaaagaaaaagaaaaagaagggaaaaaaaaagaccagatggggcaacacagaaagaccccatctcttaaaaaaaattagctgggcatggtggcacgcatccataattccatcaatttgaaatgctgaggtgggagtgttgcttgagcccagtattttgaggctgcagtgagctatgatgacaccattgcccagcctgggcaaaaaagtgagactctgtctcttaaaaaacaaaacaacacaaaaaagttcactgcatggatcatgaatggagggaggagaaagaagatatgagacattgtgggtgcaattaggaaaatctgaacgtggactcaatgtcagatgaaattatagaatgattacacatttctttttcatttttatgtttttagagacagggttgctacgttgctcaagttggacttaaactcctgtgctcaagtgatcctcccacctcagcctcccaaatagctgggactaaaagcactcgccatggaacatggctcaatcataaattttcttatatcatgatagtattacaggtatgtcaaagaatctcctcatccttagagaggcgaactgaagttgttagagataaattgtcatgatatctataacttactctgaagtgaatatgcaaaatgttaactgatgaatttaagccaagagcacagttgttcactatacttaactttcaacttttctgtaggatttaaatatttcaaaataaaaatcagagagaaaaaagagcccaaaagaaaaataaaatatatagtcactcctttttattgtttttctttttcaccaaaaattttaccaaatttaatttttttttttttttctgaggcagagtttcactcttgttgcccaggctggagtgcaatggcgcaatctcggctcaccacaacctccagctcccaggttcaagcaattatcctacctcagtctcccgagtagctgggattacaggcatgcgccaccacacccggctaattttgtatttttagaagagatggggtttctccatgttggccaggctggtcttgaactcccgacctcaggtgatccaccctcttcagcctcccaaagtgctgggattgagccaccaagcccgccccaaacttaattcttttttttttttttttttttttttgagatggagtcttgctttgtcacccaggctggagtgcagtggcatgatctcggttcactgcaagctccgcctcccaggttcacgcctttctcctgtctcagcctcccgagtagctgggactataggcgcccgccaccacgcctagctaattttttgtatttttagtagagacggggtttcacagtgttagccaggatggtctcgatctcctgacctcgtgatcctcccgcctcggcctcccaaagtgctgggattacaggcgtgagccaccatgcccagcctcccaaacttaattctttaaacattcatttttggggctgggcgcggtggctcatgcctgtatcccagcactttgggaggccgaggtgggcggatcacctgaggtcaggagttcgagaccaacttggccaacatggtgaaaccccgtctctagtaaaaatacaaaaattagctgggtgtggtggcaggcgcctgtaattccagctacttgggaggctgaggaacaagaattgcttgaacctgggaggtggaggttgcagtgagccgagatgatgccactgcactccagcctgggcgacagagtgagattctgtctcaaaaaaaaaaaattcatttttggctcacggcagcctcaacctcctgggctcaagtgatgcttctgcctcaacctcccaagtagttgggactataggcatgcaccatcatgcctggccaatttttaaaaaaatatattaaaaaaaaattattactacttttctgtaagtcaggaattatgtcaaaataaagacttaaaagttttaaaaagttgttcacacctcatatccattaggatgaccactataaaaaaacaacaaaacaaacaaacaaaaagtaggccggatatggtggttcacatctataatctcatgtccataatcccagcactttgggaggctgaggtgggaggattgcttgagcccaggagtttgagaccagcctgggaaacatagtaagattctgtctctacaaataatttttttaaaaaactggccaggcatggtggtgcatgcctatagtcccagctacttgggaggctgaggcagaagcattgcttgagcccaggaggtggagccatgatggtgcccctgaactccagcctaggtgacagagcaaaatcctgtctcaaaaaacaaaacaaacaaaaaaccagaaaataacaagctttagcaaggatgtggagaaactataacccttgtgcactgttggtgggaatgaaaagtggtgcaactgctatgttcctcagaaaattgtcaatagaatgatctagcaattccacttctgggaatatagccaaagaactgaaagcagagtctcagacatttgcacacccatgttcatagcagcattatacacaatagacaagagatggaagcaaaccaagtatcccttgataggtgaatagacaaacaaaatgtggtatatccataaaatggcacactattcagccttcaaaatgaaggaaatcaggtcacatgttataacacacatgaaccttaaggacacgatgccaaatgaaataagcaagtgataaagggctaatgctgtatgattctacttatgaggtacttagaatagtttaattcatagagacagaaagtagaatggtagctgccagggcctgggggtaaaggagaaaagggagttgtggtttagtgggtatagagtttcagatttgtaagataaaaaagttctggagatctgtttcgtaataatgtgaataatcgtaatattactgaactagatggtaagtgttatttgtgtttattattttagaaccacaattttaaaaaattgttcaccaagtacccagtagcaggggaatgaccaaataaatagaggacatcgacagcacggaacactccacagcacagagagtgagggccatctctactgctggtgcctgggacctccaggatgtcacaggtacagaatggcaaaccagtatgctgcctctggtgtgagatgggggagaaaaatatttcttgggtcagcttgttcaggtcctcgatcccttgtccaaactctttaaatcaagtgtattttagaattcagaaggttccaacgtgagaaatactgtacacatgccacataggatcttatatcccacgggatctgggtcggtgcctcctcttcaaacaccttaatatgccccccaaaaaagtataaagactcacactaggataaaaaatataattagcctcgaaaataattttgagttttgggtgggttccgtggcttaatgagtttacgccaaacttttttttttttttttttttttgagacggagtcttgctctgtcgcccaggctggaatgcagtggcgcgatctcggctcactgcgagctccgcctcctgggttcacgccattctcctgcctcaacctcccgagtagctgggactacaggcacccgccaccatgcccggctaattttttgtatttttagtagagacggggtttcaccatgttagccaggatggtctcgatctcctgacctcgtgatccgcctgcctcggcctcccaaagtactgggattacacgcgttggccaccgcgcccggcctacgccaaacatttctttaagacgtttggctgggccaaagttagctgagttatttcagttgattgttcatagtcagtaacagatcaaactcattcgtctctgtccccccttctcactactgcacttaactagtctaaaaaataataatagataaaaataggccgggcacggtggctcacgcctataatcccagcactttgggaggccaaggtgggtggatcacctgtggtcaggagttcaagaccagcctggccgacatggtgaaaccctgtctctttcaaaaaatacaaaaattagccgggtgtggtggcatgcacctgtactcacagctactcaggaagctgaggtgggagaatcacttgaacctggtaggcggaggttgcagtgagcagggatcatgccactgcactcccgcccgggcgacagagagagactccatctcaaaataaaaaaaaattaaaaaaaaatttttttttcttttgtaaacggagtcttgctctgtcgcgcaagctggactgtagtgggaccatcttggcttggctcggctcactgcagcttcaacctccaggctcaagcaatcctctcacctcagcctcccaagtagtggggactacaggtgtgtgccactgtgcccagctaatatttgtattttttgtagagatagggttttgccatgttgcctaggctaatctcaaactccaggactgaactgatctgcccaccccagtctcccaaggtgctagggttataggtgtgagccaccctgcccagccccaaaagttttttggtttttgtttgtttttgagagatggacccttgctatggtgtccaggctgcagtgcagtgacatgatcccactactcaacagcatgggagttttgacctggtccatttccatcctgggccggttcacacctctttttaggcaaccctgctccaggaaggtcaccatattgatgccaaatttagtgtggataccctgttggcatggcacactgcaacccagaacttctgggctcaagcaatcctccggcctattctcccaagtagctgagactataggtttgagccaccacgccctgctcaaaaaactttttaactgtgagaatggatgctgaatgttatcacatgcctgctcaccatgtctgcagatatgctatatagacacgtatgcagatatgttgggttgtcatgaattgatggaatgccatgattccctggcatgtaactagtaagacagattccctagcatgaaaccaattttttttttttgagacaaggtcttgctgtgtcacccaggctggagtgcagtggcacactcacaactcatggctcactgtagccttgacctccccaggtttaagtgatcctcccacctcggcctccccagaagctgagactacaggcatgcctggctaatttatgttttgttttgtttgtttgtttttctttttttttttgagacggagtctcactctgtcgcccaggctggtgtgcagtggtgcgatctcggctcactgcaacctccgcctcccaggttcaagcggtacttctgcctcagcctcccaagtagctgggattacaggcatgcaccacaacacctggctaatttttgtatttttttttgacctctgaactttttattggcctcctgctccccaaaggataccctgcttctggtggcttaatgtctcagaactttggtgtcattggtctcagacaccactttgccatccattatctggcaggtggtggtcttttggatggtttgcatggagttgctgctgtccagggcatcaccaagactgaagtcctcgccatcttccagcaggcggcagtaggtggtgatcttagcctccagcttgaccttaacgttcaccagggcgtcctactcctaggcctggcactgtccctctgcccggatttgtgccacctctgactccaggtgcagcaggatcccattgagctgctccatctacagggcatagaaggcctccacctccctgaggctgttctacaagctggccttcagatttctcaaggagtccaggttgatctccaaggactggacgtacgtctcaactccgtgattgtcatctcagcagttccaacctcagtggactgcatggtgaccactgtggtgctctcctcaatctgctgagaccagtacttgtccagctcctgtcgtttcttccgagccagctcatcatattgagcctggatgtctgccacgatcttggcaaggtcctgagatttgggggcatctacctccacagtcaacccagagctggcaatctggtcttgtaggccttttacttcctcttcatggttcttcttcatgaagagcagctcctccttgagagcttcgatctctgtctccagctacagctgagggacattggtgtcatcaatcactttgcgaagcccatgtatgtcgctctccacagactagtgcatgggcagttctgtctcatacttgactctaaagtcatcagcagcaagacgggcattgtcgatctacagaaagatacgggcgttgtccacagtatttgcaaagatctgagccctcaggtcctcgatggtcttgaagtaatgcctccagtctctgatctgggtcccttcttctccaagtgcttctggattttgctctccagcttccggttctcggtctccaggctcctcgctctgtccaggtaggaggccaggcggtcattcaggctttgtatggtctccttctcattctggatgcttcccattcctgccagatccccagccatccccgcggccaggcccccagaccccatgcagccctggaagctggtggagcgggacacgaagatccaggaaccagagccctcggtgcctgcatagacgctggccacgctgctgaccagccaggcgccatagctgggagcctggacagagcccagggaccagtagttggtggagaaggtagagcgagtggtgaagctcatgctgtccggggaggagagcaagaggacaggactcaggctttgctgatgacctaatttttgtatttttagtagagacggggtttcgccatgttggccaggctggtctccaactctggacctcaggtgatccacccgcctcagcctcccaaagtgctaggattacaggcatgagccaccgtgcccagctttgtttgttttttgctttttgaggcagaatctcactctctcatccagtctggagtgcagtgacgcgatctcagctcactacaacctccacctcccaggctcaagcgattcttgagcctcaccctcctgagtagctagaattacaggtgtgcaccactacgcccagctaatttttgtatttttagtagagatgggtttttgccatgttggccacactggtcttgaactcctggcctcaagtgatctgccggccttgggcacccattgtgctgggattacatgcatgagccactgtgaccagctctaatttttgtattttttgtaaacatggggtttcgtcacgttgcccaggctggtctcgaactcttgggctcaaacaatctgcccaccttggccttgcaaaacgctgggattataggtgtgagccactgtgctcagcctttttttttttttttttacgagaaaagaggtctcttactttgtcatccaagcgagagtgcagtggcatgatcatggctcactgcagcctcaacctctcaagctcaagctatcctccctcctcagcctcccaagtagctgggactataggccacgccaccatgcccagctaattaaaaaaaatttttttttctttttctgaaactgctctgaaaaaatttaaatggcattggagtcttttcataaaaggcacacctaccctggaaaacatctgggctttgtgttttgtggggaatacaactttctctctcttttggggataaagtgctattaattttttaaaaataaaatcatcaattgtatccaaacttttaaagtaacagacattgagttcagctaagcagtcttttataattcacagatggaatgaaaactaagggagggacgaggtgacccatggaggttgtataaaaaggacagagcctttgggctcttcagactataagggtccaggaggagaggagaaaccacctcagaagcatacaaggttaaagcatacaaggtgggtgtagggtcaggggagccaaagtaagtgtgcaatgaaaagttattaacaaaagtcaaaaaaagaaaatgcagtctggccatccaattcctaaaccatgtacagagtacacagaaagagcacaggaggcttcctgcagcagggcagtacagctctctgcccttcaggaaaactgagattcctccacctgggaaacagcaagggacaattagggaaagctctccagaggaggaggcatctcaggtgggccaaagaagaaaaatttccacaggacagaaaaggcagagaagaggccaggcatggtggctcacgtctgtaatccgaacactttgggaggccaaggcaggcggatcacctgaggtcaggagttggagaccagcctggccaacatggcaaaaccccgcctctactaaaaatacaaaaattagccgggtttggtggcacacgtctgtaatcccagctactcaggaggctgaggcaggagaatcacttgaacccgggaggcagaggttgcagtgagccgagattgccccactgcacttcagcctgggggacagggcgagactccatctcaaaacaaacaaacaaaaggctgggcgtggtgtggctcacacctgtcatcccagcactttgggaggccaaggagggcaaatcacaaggtcaggagttcgagatcagcctggccaacatggtgaaaccctgtctctactaaaaatacaaaaaattagccgggcgtggtggcgcacacctgtagtcccagctactcgagaggctgaggcaggagaattgcttgaacccggaggcagaggttgcagtgagccgagatcacaccactgcactccagcctgggtgacagagtgagattccgtctcaaaaaaaaaaaaaaaaaaagaaatttatgttctttgtaaaataattcagacaatgcagtaaacagaagaaattcagcctccctctccctttgccctttgctgagtccccacggtgcagcaagatccttccagatcttcatggttgggatcatcttccaccaggtcctgaggtttttcactccctatcagtagacacaccacactgcccagtttgcaagtagctccattggataacacagaaaggctctgtcctgcaccatgtctcagcactgggtgcatcgtcccacaggaatgacacctagacacccaacatacaactgcagggccctaaactatgggccagcccacccctaaatgcccttctctctacccttgcccatatcaaatattacaagcctctcacacatatttaccagtcatactgggaaaaaaatagtcctttatcattttaacatttcacaagtaactaaaacaaataataaacatgctaacacttgggaatggtctatttcttttctttttttttttttttgagacggagtttcattcttgttgcccaggctggaatgcagtggcgcaatctcggctcactgcaacctccgcctcccgggttcaagcaattctcctgcttcagcctcctgagtagctgggattacaggcatgtgctaccacgcccagctaattttgtatttttagtagagacagggtattgccatgtgggtcaggctggtctccaactcctgacctcaagttatccgccctccttggcctcccgaagtgctggaattataggagtgagccaccaagcctggcctctttctaggctcactgcaacctccgcctcctgggttcaagtgattctcctgcctcagcctcccaagtaactgggattacaggcatgtgccaccacgccccgctagtttttgtatttttagcagagacggagtttcactatgttggccaggctggtctcgaactactaatctcaggtgatccacccgcctcggcctcccaaagttctaggattacaggcgtgagccactacatccagcctcttttttgtttttttgaaacagggtcttgctctgtcacccaggctggaatgcagtggcacaatctcggctcactgcaacctccgcatcctgtgttcaagcaactctcctgcctcagcctcccaagtagctgggattacaggcgcccaccactacacccagctaatttttttttttttttttagtagagacagggtttcaccatgttggccaggctagtctcaaactcctggcctcaagtgatccacctgccttggcctcccaaagtgctgggattacaggtgtgagccaccgtgactggcctctatttcttatttatacatacacacacacacccccctgtgaaatgactctgggctcttccaataatgttgccactctcccgctccccttcccaatggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagcgaaaggctgcctacactgtcatcttcagaaagagtggtatgacactaaatcaagaagggctgagagggtgagcccaggggatcccataggctccacagcctctggccatcctctcctatacaggtcctaagtcccctgcagggggccctcagctcctctaccctacccactgtcctgtatgttatcttaatgcttattaaaggcctcagctgaatttccctggtgaactgaaagaattctgctgctcctggacacatctgcaccaagccaccactgggtcacattctccaaaactccttttggagacagaaggcacttaaaccatacatattttgcttgatagttcctaattaaaaaaatagagagagataaagagaaagagagagagagagaactacaactaagccttgaagacaaaatgattgaacagaatcagagctagaatggaacacctcaggcttggagtcccatgacaaccttgctggggaccacgagtggccctcagtccttctcaggctcatgccacctatgtgaaataagggtggtgacacccacctccttgagtgcagagcagtgcagacaacagggcaaatggtgtattgatctgctatctgtgtacataaatttattcatttaagccatgggtattgtttgaatatgtgaaaaccatgtcaggtgctagggataagagacagattccaacccagtggaaaagacagataagccagtggttcctcacactgtgccaagtgctgggatggggtcacgaaggaggccataagaaaccccagaggggccacagagctcactgggagggccagaggctaacacctgagggatgagaggtgtgagccagaaggtgatgcatacacagcaataattactgacggaggggaggaatggtaagggaggggaggagagaaaggaggaaagaaaagagaaaagaaaagagagagaaaaggaaaagaaaaggaagagaagagagggaagagaagaggaggcaaagcccaagaaacaggatcactgaatgaaaaatgaactctaagacccccttctgtctctcacacttgttgactaagtcatagccacaaggagtaggggaggctctgaggtgagcaggagaccagccactgtcaccgccagtacctttactagcagagccaggattacctttgttattcttcttacaaacagctctagtgaactcacctgaagtaatcgcaggacgcagccagcaggatgcgatgggcctcgatgtgtctgccctccaccaccagcacaacatcgaagaggattccgctgtcccggagagccagcagccctcggagcagagcctgggagtgctgtgcgctgcggtaggtgttgttcacgcagtgtgggtgtgagggctgtgcaggcaacttgcagagctgggtgaactcctgctcctctgccatcctgacagccacaagatcccttacaactgtggcctgacagttggcaaaacaggggacaggggtgagcaggcaggcatcagccccaccacacacagactggccagctctgttgctccccttgctcctgtgcctccctcaggctcacctgttttccctctatttccaaatcccctaattccttctcccctcccacctctagtccaacttcctgatggccttcttcctgatgacctgtgtgccatcatgcccaagactcttcatctcattgtatcttcttcagcggcaaagtcaaacagaagggttttgggaaacagactgacctgggttggagcccaactccacagggacttacaacatgaccaaactgagcctcgagctccccaattttaaaaagagagataaaagtacctaccccattggggtattctaaaattggtaaaacaatgaacatgaagcataagcacacaccaggttctcaagagctcttcctccctcccattgaatgaacaaaattgggttcttcctcatagtaatggatgcataaaaatggcaagacctgagtagtggtcaggagacacacagccaggagtctgggaggtgggtgccaagggggtggcatttccagggcctactttcctttactgaaattctgagagtcaagcacagtaactgtgattgaacctgatgcatttaaattcatctgcattgccttttaaattaaagattatcttctaataattgagtcagtacgttcaaaaaccgcaaactgatttgaattggagcctctaaaacctaatcagtaaaatgaacctactgcaaatgcacttttgccatggagcaaccaaaagtgactgtggatagccagctgttcaggtcagggagtggccagtcccacactgtgaggcatggccaagctgcaggctctgtaggcacagcacagtcagctacaagatgtgaacatctgtcttctccacctcacttcatcctactttcctctccccaaaatatgtttattctccaattacctccagtcatgcatcacttaatgttggggatacattctgagacttatatcgctggaggcaatttcctcagtgtgtgaacatcaaagggtacacctacacaaacctaggtggtagagactactacacatctaggccataaggtacagccaattgctcctaagctacatacttgtacagcatgttactgtagttctgaatgaaaaaaacacactgtttttcctctcctcttataccacaacaacaaacacaggagacttctgtgaccaaatgtgtgagggtttttccccattaacaagcaagcaatcaattctgccacagataccagctgggtgtcttctaattcagcagtccccaatctttttggcactagggaccactttcttggaagacaatttttccacggggtcggggaatggtttcgggatcaaactgttccacctcagattatcaggcattagctagattctctttcggagcacacaatctggacccctcacatgcatggttcacaacagggtttgtgctcctatgagaatctgatgccacctctgatctgacaggaggtggagctcaggtggtaatgctggatcaccctccactcacctcctgttgtgccacctggttcctaaccagccacagactgatacaggtctgaggcctgggggttgcggacccctgctctaattcaactctaacactacctggagacagtgtctgatcccacaggttgagggctgagtctcccaggttgtttcacctgtgcttctgaccaataggctataaattgggttcccaagatccccttcttgggttcaactaatttgttagagcgactcacagaactcaggaaaatactcatgtctactggtttgttataaagggtattgcaaaggatacagatgaagagatgcatggggccagacatgtgggaagtggtgcagagcttccaggccctctccaggaacatcactctttaggagcctccatgtgttcaactatccagaagttttccaaacccagtcattcagaatttttatggaagcttcattatgtaggcatgactgattaaatcactggccattggtgatgaacttaatcttcagcctgtctcccctctccggaggttgagaggtgaggctgaaagtcccaaccctcttatgcctgccttggcctttcctgtcaccagcccccatcctgaagctacctaggggctgctggccagcatacaaaaaggcatcactctggaaagtccaaagattttagaagttgtatgccaagaaatgagacaagaccaaatatatatttcacaatatcacagtactgaatactataggcaactgtaacacaatggaatttgtgtatctaaacacagacaaggtacagtaaaaatatgggaccaccatccttcatgtggtctggtctgtcattgacggaaacatcactgtgtggcacatgattatatatctttaaaagaaaaaatgaaaaatatatgctgatataaaacttgccaaaaagaagaggtctctctcttcactactgaggctcagggccacccccaaccccatcccctggatgctctactgcttcccatcaaacacactcagttatctgtgcctgcccctgagtctgcctccaggacctgggacctctatccagccacccacccattcctttccccctcctgggctggctcatctttctcaccaaggccccagagatggccacagccaaggtgtataccccatgaccacctctcacttaggattctcttgcctggaaactctgctctatgataattctcccttttctgacctctctctttcatcccacacaccctgctcgagcccatccttctttcccagtggttcacattcccagtttcacctacagctcagtgcctaatctagctagtagccctccaacttgtctaattttactatcaaagctaccatttccatcttggaaacctcactgttttaatatttttcctttctaacccatgtgccctatgaacctactagttctgattccttcacctctcctccatctcagacagccaccctccactcctccagggccaccactctgggtcagaccacagcagtgatgcccctaccagtttccctacctcttgtctcatcctccccaggctgctctccttcaagccttacctactcagccccatcagcagtccttagtccaaaagggatacctgtcatcccctgaacacctttagtcacccatctaggccattctgtctctcatagtcccatattggtcaaggtctagctcgattacttctccctctatcattgtacagagaacatgacaaatatgccccaccattcaaacctgcccttttttttttttttagacggagtctcgctctgtcacccaggctagagtgcagtggtgtgatcttggctcactgcaacctctgcctctcaggttcaagtgattctcctgcctcagcctccccagtagctgggattacaggcgtgcaccaccacacccagctaattttcttgcatttttagcagaaatggggtttcaccatgttggtcaggctggtctcgcattcctgacctcaggtgatccatctgccttgacctcccaaagtgctgggattacaggcatgagccaccgcgcccggcccaaacctgcctatttacccacgacaaggagattccggcttcttgaggggtgaggttttatctcacaaacatctcaaaagcccccatggctggctgtaccacttgctaatgacagactctgggcacttgtctcatatacccacgcctcagctttctcatcaccaccatgaccaccgcagagtcaagagggcctccttctctgagggtgacctccacaactaccccaatagacatcaagcccccaggtggatcctcaccttccgtgagcatagtagtgcctctgctctcttgggaagggataaatggcagctactccctaaacccatactgcaaaaacaagtacggtaaaacagaaagacatcttccatgggcaggcaaagcacatttaccaagtccaatttaagaaacttagctaggggctaagggggatatgctgaaaaatgaatcaattctctgctgggaaggagcacagcacagggtgcaacatttaaaacatttaaaaccacatctatacggttttaaatcaccaaaacgtccaccctcaggagaacagatgtcatggcacagtgatctgacagaacattaggcaacagtcaaaatgcgcaaagtggccgggcgcagtggctcacgcctgtaatcccaacacttcgggaggctgaggcggatgaatcacgaggtcaggagttcaagaccagcctggccaacatagtgaaaccccatctctactaaaaatacaaaaaaattagccgggcatggtggtaggtgcctataatcccagctacttgggaggctgaggcaggagaatcacgccactgcattccagcctgcatgacagtgcgagactccgtctcaaaaacaaaaaaacaaacaaaaaaacaatgtgcaaagtaggctgggcacagtggctcatgcctgtaatcccagcactttgggaggccaacgtgggaggatcacctgaggtcaggagttcaagaccagcctggccaacatgaggaagccccatctctactaaaaatacaaaaattagtggggcgtggtggcgcatgcctgttatcccagctactgggaaggctgaggaagggggaagctgaggcaggagaatcgattgaacccaggaggtggaggttgcagtgagccaagattgtgccattgcactccagcctgggcgacagagccagactttgccccccccccaaaaaaaaaagtgcaaagtaggctgggcatggtggctcatgcctgtaatcccagtgccttgggaggtccaggtaggtggagttcaagaccaccttgggcaatatagcgcgaccctttctctacaaaaaatttaaaaattaactaggcatggtggtgtacacctgtagtcctggctatctggggtgagacagcttggggttcactgcagtctcaagctcccaggttcaagtgatcctcccacctcagcttcctcagaagctggaacaacaggagctcaccactgcgcccggctaatttttcaaattttctttgtagagaagaggtttcactatatggtgtaggctagagtgcagtggtagggtcttggctcactgcagccttcatctcctgggttcaagcgattctcctacctcagcctcccgagtagctgggattacaagcacgtgtcaccacacccagctaatttttgtatttttagtagagacggggtttcaccatgttggccaggctagtctctcctgacctcaggtgatctgccagccttggcctcccaaagtgctgggattacaggcatgagccaccgcgcccgcccccagtctcatatccccaattttagtcatcacaagccaagttccccgttttgtactgttcgaagtttcagtggggagaagaaaggaagcttaatgtgccacatagctacaaactgaaggatacaagatgaatttttatgaagtgatggatggcagagtcaaaatcatttcagaggaactttcagttcggtacgattttactgagtagataccctcagccttctgtagggcccccgaacgagcagtatcccctcaaagaaactcaatccttggcagcatgaagcaaggtcggccacaaaggcaaagggggcggctgcggtagaggagagggagtgggtgctgattcccagcggggcagccttccaaagggtgcgctctggaagaatctcccagggagccgtcttggaggcactcggccccgcggagggccggagcgagggcgcccagtgaggagcccaggcggaaggtggcggtgccccgctgcccgccccagatccactcggctcggcccgcaccggatctaaaatggtcagaactggcagccgacgcttcgcgctctggtgattttgcactgacagcgcgatctccggctcctctcaggaaaccgggagagctggcaaggctgggctcctacggctgcagtccccgggcccgatcgagggaactgaggctcgtcaggccggccccaaatcgcccgcctgttgcaaggccgcccgctccagcgcggagggtcgcggccaggaaggccgcattcggacctgccgcaggcaacagggcccgcccgggtgccaggaggccggcgcgccagcagccgcgctgaggaggcctcgcaccctggcccctggccgagcgccagatcccggcccctacgcgcccgcgcccggggatcccgccggccgcgtccccgccacgtcaggccgcgggctctcctcaggtcgccgcccccgagcctccggcccgcgcccgcccccgcgcccctcggactccgcgccgctagcttgtccccggcccagcgatgcctgcttgccgcccgacccccgcgttcgctgccgcccggcccgttcggctcacgcctcgcagctgacctggtgccgccgccagccgaggccgcactcgcagctggagggaggcgggaggcgggaggcgggaggcgcgaggcgggaggctgggcgagaggagccggcggggcgggggcctgggccgtcacgtgggtgcgccgcgcaggcgccgggcgggccagacgtaggcccgggggttcccggcctggccgggtagcagcgcgggggcggccctggggcggggagacagggggcggctccactccggcgctctgcggaggacagcagcgatcgccaaggctcagtgagtccccgcactagcgcggcacctggcacttggcggggccgaaccaacgaatgagcgaatttgccgagagtcgccccgtctgaatccattgactctttccttgcctcggtcctaccctcattcctcgactcacttcctcctgcccttcctcactatctccctccccgctcatatcctccctctcctttcctcattcccttcttcactctcttctctcctctcttactccccccctctcattccctccctccttcactctctcattccttcccttcctatcttacccaccattcccttcctccctcactcattcactccctccctgtctccccctctcatcccctccctctctcattccctttccctccctccttaactctcgttctctcctccctctctcattccttccctccctgtctcatttccccccttctttccctccctccctctcctcttctcccattgcctccctccctctttgattcccttctttcctcctctcctccacttgttcccttcgtcacgcgctcattccctccctcccgcggcctgctccttccccgctccctccgcggtcggtgccgctgaccgtagcgcgccccctgcgggatatcggggagaatcgcttaacaccgccagagtgaacaggtgctagtttgtgtgcccgttcctttactgagattttgcagtaaatctaattcccagtcttaaagcctggtcccagaggtccgtgcgcgggtcttggcattcattgttctccacctcaccttcgagcaggtcccatcctccgaggcgtatccgtaatggctgcgcccagagcttggagccacagagcctcctgatgggataaggttggagtgtcccacactgtggttttgagagggactgtgaagggtggagagagtggtagggggaggatgtggctggagatggctcatggttaaaaagaaaggtggggccgggcttggtggctggcgcctgtaatcccaacactttgggaggccgagacgggcggatcacgaggtcaggagatggaaaccatcctggccaacatggtgaaaccccatctctaccaaaacacacacaaaaaaactagccggtcgtggtggcgcgcacctgtagtcccagctactcgggagcctgaggcaggagaatcgcttgaacccgggaggcagaggttgcagtgagccgagatcacgcgccactgcactccagcctggtgacagagcgagactccgtctcaaaaaaaaaaaaaaaaaaaaaaaaaaaaattggtggaaggggaatgtaaaaggaggaaaatacacggaagagaattgctgtcctggctgagtccagagagataactgagggtcccagacaaggatcaagagaacgggattggcctccagaggcagaggttccaaatgggagtgggcttcctcctagaaagactttctggaggagacccccctactgtgtaacagaggaggactttgggattaagaaaagcattccaggaagccgacagtgtcagcaaacgtggaggtgagatccttcaaagtgagtggtgtggaggtttccagaattttctgagcctgaagggaaggttggagagcagaccctgccctttggaggcttgacttagccctgagggcaccctgtagccagggtgggcagatgccaatatggtagagacgaagactgagtagggagccagccacagtgctgtggtctcaggcagggagtgaagaccagagtggagcaggctagaaacctgggaaggaagcaggttccccagtataagcccagtgatgtgtgaagaatgagcccaggagatgggtggggaagtaggcccaccctgcctacaggggagccagagcaagagcaggtctgggggaagatgaggccccccttggctccaggtaggggaagactgacctccaaggcccaatgggaccaggtgtacgggtggacccagagaggagaggaaaaggaatcctggggcagcaacaagaaggccactgtggtctgaatgtcggtacccccaaaattcatatgttggaactgaatcctcagtgcgatactattataaagtagggcctttgggaggggtttaggtcatgagggtgaagtcctcaccatgggatcagtgtataaaagaggttcgaaggagctcatcccccacttttgccaggtgaggacactgtaataagcaccatcttcaaggcagagaatcggctgggcgcagtggctcacgcctgtaatcccagcactttgggaagccgaggtgggaggatcatgaggtcaggagatcaagaccatcctggctaacatggtgaaaccccatctctactaaaaatacaaaaaattagccaggcatggtggtgggcgcctgtagtcccagctacttgggaggctgaggcaggagaatggcgtgaacccgggaggcagagcttgcagtgagctgagatcgcgccactgcactccagcctgggtgacagagcaagactccgtctcaaaaaaaaaaagcagagaacggacccctcactagacactggggcttttttctgaaggctactgtgtcatataaaatttatattaaataaattgatatgcttttctcttgttaatctgtcctttgttagaggggtgtcaaccaggaaccttgtgatgcgtgaggaaaaaatattaccttttccccctactctttctggcacccaacaaacaagtggggtggcaaagacaccccacttgggacaactggcaaaaggtaagcattcttaccaaggttaactgtcccatatcactgcctgtagtactcagctgagagtggaaggtaaaaacttcttgtcccttcctttccaaattcaaattagcagaagaaaacattgtgtctggattgtgactcttgcttaaatttggttgaggggtaactgtttgttattgatcctttcctcccaggcacagctacctctttcctgtttgttttatttgtgtcctgagagcttggctttatgaccagtgagaatattctccctgatctctgaatagccagtgggtgcaagtgacagcttgctttaggacagcttgcgttagggttgcaagtaacagcttgcattattacaaactcctctgtcccggtcagaaaaagagaaagtttggtttttgtttgtttgtttgttttttgttttgttttaatagtcttgctctttcgcccaggctggagtgcagtggcatggtggcatgatcttggctcactgcaactgctgcatcctgggctcaactgattcttctgcctcagcctcctgagtagctgggactacaggcacacactaccacgtccaggtaattttttttgtatttttagtaaagagggggattcatcatgttgcgcagggtgattttttttttttttttttaattcttttctgagacggagtcttgctctgtcacccaggctggagtgcaatggcgggatctcggctcagcctcctgagtagctgggattacaggcacctgccactacgccagctaatttctgtatttttagtagagacagggtttcaccatgttagtcaggctggtctcgaactcctgacctcgggtgatctgcccacctcggcctcccaaagtgctgggattacaggcatgagccaccgtggctggcctcttttatttttaagatacagggtctcacccaagctggtcaggaactcctggcctcagtccacctgtctcagcctcccaaagtgctaggattacaggcatgagggaccacgcccggccaaagagaaggttctgaaccttctctttttctgaccatgacagaggagtttgtaagtgggccaagtctataaggggtttttgttgtctcagtattcattggtgtgatagatgagccagtccatgactggagacgtgacagtgttctgtacaagatgacatccttagtcacctgtgtcaacaaaggtgccttctggctaggcacggtggctcacgcctataatcctagcactttaggaggctgagccaggcaaatcacgaggtcaggagttagagaccagcctgaccaacatggtgaaaccctgtctctactaaaaatacaaaaaaattagccaggtgtggtggcgcatgcctgtaatcctagctattcgggaggctgaggcaggagaatgggttgaatctaggaggcagaggttgcagtgagccaagatcgcgccactgtactctagcctgggtgacagagcgagactccgtctcaaaaaaaaaaaaaaaacccaaaggtgccttctttcttttgactgtctttgcaaggggtctggatttgagagtgctgaatctttgtgcaccctctttggagtgtgtctttctctctctctctctctcttttttaagagacagagtctcacccagactgatcaggaactcctggcctcaggtggtcctcccaccttgacttcccagagtgctgagattacaggcatgagccattgtgcccagccttgaggatgtctcttttgtccatggttaagtcataaaatgcttattggtcttggttctgagttgcttggtaggtacctttggtttacaagaagaaaagtggtgggtgggcagggtggtagtagggaagagtgttcagtactgccaggaatatgtactatctgttctggctgaaaactgacaatgagatatttgaaaggattttttttttttttacagctctatgatcagaagatggcataagtggggctgggcacagtggctcagtgcccagctgggattacgcctgtaataccagcactttgggaggccaaggtgagtggatcacgaggtcaggagttgaagaccagcctggccaacatggagaaaccccgtctctactaaaaatacaaaaaattagccgggcgcggtggcaggtgcctgtaatcccagctactcgggaggctgaggcaggagaatagcttgaactcagagggcggaggttgcagtgagccaaggttgcgccactgcactccagcctgggcgacagagtgagactccgtctctaaaaaacaaaaaagaagatggcgtaatcagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctcctttccatttgcttctgctcccccttcctccttttgccaccttcgatattttctccagtttccttgattcctttgatacgtccccattcaggccactctggccctccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcactttgggaggccgaggcgggcagatcacaaggtcaggagttcaagaccagcctggccaatatggtgaaaccccgtctctcctaatgatacaaaaaaaattagccaggtgtggtggcattcgcctgtagtcccagctacttgggaggctgaggaaggagaatcgcttgaacccgggaggcggaggttgcagtgagccaagattgcaccactgcaccagcctggcgacagagcaagaagactccatctcgaaaaatatatatgtatgtatatatacgtatttacgtgtatatatgtatgcatacatatatatatatatagagagagagagaaaccagtgagtttgtattactgtgttttactgactcacgactaccattttggaatgaaagctataagatctttgtgtttttacgtttatgtgtttatatttgtgtatatctatgtatgtatgtttgaatattatatataatattttttctatctccatattcagtattactaactgaatttttttttttttttgagatggagtctcactctgtcaccaggctggagtgcagtggcatgatctcggctcactgcaacctccgcctcccaggttcaaacaattctcctgcctcagtctcctgagtagctgggactacaggtgcgagccaccatgcccagctaatttttgtatttttagtagagacgaggtttcaccatgttggccagcatggcctctatctcttgacctagtgatccacccacctcggcctcccaaagtcctgggattacaggcatgagtcaccacgcccagcctaaattttttaaatcccttaaaggagttatattcaaattgtaccctcctttgaagatgtctcttttgtctgtggtgtcttaaaaggattattggtcttagagggaggtaaataagcattcatacaagctaaatattaccaaaaatttaagaaaaatagaaactaatccaactgctttttagtttacatgatctggaatattctttagtaaataaagctagtttgaaaattgatggactacgccgggtgcagtggctcaggcctgtagtcccagcactttgggaggccaaggcgggcggatcacgaggtcaggagatcaagaccatcctgactaacacggtgaaaccctgtctctactaaaaatacaaaaaattagccaggtgtggcagcatgggcctgtagtccccagctacttgggaggctgaggcaggagaatggcgtgaacccaggaggcggagcttgcagtgagctgagatcacgccactgtactccagcctgggcaacaaagcaagactccgtttcaaaaaagaaaattgatggactagtcaaacaagttttatgttatcactactgaatggtaaagataataaaactatcaatccaacctaagagcaaaatgtgcaataaaaatgaattgcggctgggctcacccctgtagtcccagcagtttgggaggccgaggcgggcggatcacctgaggtcaggagtttaagaccagcctggccaatatggtgaaacctggtctctactaaaaataaaaagtaaggccaggtgtggtggcgggacctacctgtaatcccagctacttgggaggctggggcaggagaatcgcttgaacctgggaggtggaggttgcagtgagccgagatcgtgccactgcactccagcctgggagacagtgcgagactccatctcaaaaaaaaaaaaaaaaattgggcacggtggtacaagcctgtaatcccagctacttgggagtctgaggcaggagaattgcttcaacctgggaggcggaggttgcaatgagccaagatcgtgctgctgcactccagcccaggcaacagagtgagactttgtctcaaaaaaaaaatgaattgcatggcttggcgcggtggcccatgcctgtaatccagcactttgggagactgaggcaggtggatatttgaggtcaggagttcgagaccagcctagccaacatggtgaaaccccatctctactaaaaatacaaaaaattagccaagtatggtggcgtgcgcctgtaatcccagttacctgggaggctgaggcagaattgcttgaacccaggagctggaggttgcaatgagccaagattgcaccactgcactccagcctgggcaacagagtgagactccatctcaaaaaaaaaaaaaaaagaaacaataaccactccctccctacctccacatacataagtgattacaggctccaggccaaacacacagaggagttacatctggctggtgctaggatggaaggtggggcaggtcaccacctcccagggactgagtgccaaagcaaggaggaagattggaggtgaggctgtatggagacagccacaggctcacagagcttgtgctgagctctctagggggaagcttgatctgcctgggaagcttccagctcctacctcctgcagagcccagaatggtgtccaggaaatatgtggccattgagtggaaccagccttggcatggtagcctgcaggaacccgcaggctagagacatggccacatgagcagtgaggatctcccccgagatgaggatccccagaacatagtgtgggatgcaggtctggcctctgcataccctcggcttcctccatcacttattctcagacatctaaaccactaacatccagactggggatcccaggagggtctacagtgtcaagagagggcaagtccacttcaggatcaaccttcctgtggccccttactttccttggtccacctttccaggtcacccatccagactgtcaccagggatcactgccctgggcaccaacccaatgcggggacaagtagaaaaagagctctggggaaaataccaaagggaatagtcactcaattttactgtgatgataaactcctggcaaagttccaggcctctctctgtctgtgtctgtgaattatgtgtctgtgtctccatcaaccatagtgcagaagggggagggttgtcctaagtatcctattaacatgtttgtttgtttgtttgtttgagacagagtttcgctcttgttgcccaggctgcagtgcaatggcataatctcagctcactgcaacctccacctcctgggttcaagtgattctcgtgcctcagcctcctgagtagctgggattacaggcacacaccaccatgcctggctacttttgtatttttagtagagacggggtttcactatgttggccaagctggtctcgaactcctgacctcaggtgatccacctgcctcagcttcccaaagtgctgggattataggcgtgagccaccatgcccagccagaacacaggactttcaaaacttaaacctggggctgggcacggtggctcacacctgtaatcccagcactttgggaggccgaggcaggcggatcacctgtcaggagttcaagaccagcctgggcaacatggtgaaaccccatctttactaaaaataaaataaaataaaatacaaaaatgagtcgggcgtggtggcgcactgtagtcccagctactggggaggctgaggcacgagaatcacttgaaccccggatggcggggactgcagtaagcgatcacgccactgcactcaagcctggcagacctagcgagactctgtctcaaaaaaaaagaaaacaaggctgggcgtggtggctcacgcctgtaatcccaacactttgggaggccaaggcgggtggatcgccaggtcaggagattgagaacatcctggccaacatggtgaaaccctgtctccaccaaaaatacaaaaattagccagatgtggtgccaggtgcttgtagtcccagctactcaggaggctgaggcaggagaatcacttgaacctgagaggcggaggatgcagtgagctgagattgcgccactgcactccagcttgggcgacagagtgagactctgtctcaaaaaaaaaaaaaaaaaaaaaaaaaaaaaaaccaagggccgggcgcggtggctcacgcctgtaatcccagcaatttgggaggccgaggcaggcggatcatgaggtcaggagatcgagaccatcctggctaacacggtgaaaccctgtctctactaaaaatacaaaaaaattagctgggcgtggtggcgggcgcctgtagtcccagctacttgggaggctgaggcaggagaatggcgtgaacccgggaggcggagcttgcagtgagccaagattgtgccactgcactccagcctgggcaacagagcaagactccatctcaaaaaacaaacaaacaaacaacaacaacaaaataaaacaaggaaaaaaacactaaaaccttggatgtcctgggcaaccccggtcaagatgatcactctagatagagtttttaaaaattagttttcagcctggccaagatggtgaaaccctgtctctactaaggatacaaaaaattagctgggcttcgtagcaggcacctgtaatcccagctacttgggaggctgaggcaggagaatcacttgaacccgggaggcagaggttgcagtgagccgagatgtcaccacagcactccagtctgggcaacagggcgagactccatctcaaaaaaaaaaaattagttttgccaccgggcacggtggctcatgcctgtaatcccagcactttgggaggccgaggtaggtggatcacctgaggtcaggagttcgagaccagcctggccaacgtggtgaaaccctgtctctactaaaaatacaaaaattagccaggcatggtggggtacgcttgtaatcccagctactggggaagctgaggtgggagaattgcgtgaacccgggagacagaggttgcagtgagccgagatggcaccactgcactccagcctggccaacaagggctaaattctatcccccccccctcaaaaaaaacaataacgattttgggagtattagagcagaaaacgtttgaaaacatgaacagctctcacatcaacacaagacatgaaactctgttggcaagagaggcctctttggggagagtgctcactcctctcccacccactctctaccaccttcaacctcctgtctggggcacagtaacaaggggtgtaaggggtgtacagtgcctagcaggggcctggcacttaggcttcagtaggtgccagtccacagtctcctgaggcccatgttggttggtgtccacctggtgcttattgaccacttgggctccagattttcctcacgtcacctccctccccagggtagcagataaaggccccatagttccaaggaggcagaacttttacattcctaaaagcattctcaggcccccataacccctcatcccaccttcagctcgctcaccttcacctatcaaattcgtttgacatctggcctccagcaactagctaggctgagttctccatgaaggggacgtggctgctggtcaaaagggaaagcccatgtctaaaaattaattaacgtggtttaggggcctcacattcccaacccccaaatacagccattgtgagatgtgagattcaaaaaatcgaagagtgaagcggtgatgagagtccatctggtcgctcttcggatgcggcgctagcaggcagttgcatgaaagcagatcccagatcacgttgcactggcacacagtaggtacccacacatatttgataaataaacactctctccctagcattactatagatagctggcagcttggcctggcatcccggaggggtctggatctcagggactagataaggccagcacactgaagagttgcagaaaatgcaggcggtcaggcgcaggtctgctgcgggagcacctgccgtgtccgacagctgcactggaagaggggcgtgtgtctcccagccgggcggaaccgagaccgcttcgtccccggcggggaacttcatttcccacaagcctgtgcgcgagactccatttcccacaagccctccttcacttccggctcggccgaggcactgcggacggcttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatgtgagtagtggtcggggcagggggctggattgtgggaccttcctccttagcgtggcgggcgaggccagggccggacccgtgagaaacctacggcgccgggagacagaaggcgccggggacttgcgtgggtcccagggctcgggcccccccgtctgtcccctccgttcccgacatggactgctcgtttgctttcctggggccgagctctgcaaaccaacgagccctggcttatgaatcatcgtcttgagctttctcattcgtcatttgtgtgctttgggtgcagactttcccccgctttttgaaccacactgaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtgtgagcaataaagctgtttatttcacctgggtgcaggtgggctgagtccgaaaagagagtcagcgaagggagataggggtggggtcgttttataggatttgggaaggtaatggaaaattagtcaattgttctctggtgggcagggatggatctcacaaagtacattctcaagggtggggagaattacaaagaaccttcttaagggtgggggagattacaaagtacattgatcagttagggtggggcaggaacaaatcacaatggtggaatgtcatcagttacggctgtttttacttcttttgtggatcttcagttacttcaggccatctggatgtatacgtgcaagtcacaggggatgcgatggcctggcctgggctcagaggcctgacagtttttaactgagcttattggcgtgttgtgctcgccacagatttgcctgagacacagcccctttcctgagggatggtaaaggaaccgtcacagcgcagtcttgtcagtctgtaatgtgtatactgcaggggtttcttgcgaagcggcggttaacttgagcagaccaggggcagtctagtgagtaggtgacgaataaattgagtcctagaaagacaagtaggagtgtgaatagccaccattccaagctgaggagttaggaaacatgagcatttactgcgtggagggaggatcttgtaggctgagagttctggggctcgaggagtaagagagcccaggagatgatggaatgagggtgagcaggtactagcactttagtgggggtgttgtgccaaggaattgagcctgtgtttggcatgtggcattctttggagtagtgaaatgccagtgttgggaatatgcctagagtccctgtccctggagatggatgcagggcagagaagagagaccagttaagctattaagagagtttgaacatttggagggagtagggaacctgtcctttttcatccttatattctcactgctagctcactgcctgccacattgctccgtaaaatgattgtggcatgacctagtcgggcgggagattataaaggcctgcattagacagtggtagaaactgaaagaggaagacagattccagaggagggggaacgtagacaattcttgatgactaactggatggaggggggtggggtgtggggtgaagcattgtggaaggaaggaagccgggctgaatgctgggaaacctttcagtacagtggaaagagtagggactgtagagttagtagctatgggctttgggaagaatagccttgggatatttctggggatattgcacaatcagtgaacagtgttttactgataaaatatagttatctgtaggtgaaaacttgagagatatcccacttcagggttcctgcaagaaaagtccccagggcaagggttcttctctgggaaagcccagaattaagaactggaagggtgagttgtcatcaaagaaaatgggggtaggggaagtgttaagagggctgggagggtgattgaagagtttatgggtgttgagtgactggatacttcataactcagctttattttgcttccgggagaattgagttctttatttttttcgatattgctgtttgtgtgtttttctgttgccgctctaacaaattaccacaagtttagcatcttaaaacaacacacctttagccaggtgtggtggctcacgcctgtaatcccagcactttgggagactgaggcaggcggatcacgaggtcaagagactgagacccatcctggccaacacggtgaaaccctatctctactaaaaatccaaaaattagctgggtgtgatggcgcacacctgtagtcccagctactcaagagtctgaggcaggagaattgcttgaacccgggaggcggaggttgcagtgagccgagatcgcaccactgctatcccgcctagtgacagagcgagactccatctcaaaaacaaacaaacaaaaaacacacatttatcatttggtagtttctgtaggtcagaggtccaagtaggttccactaggtctcctgctatcaaggcctatcaaggctgaaatcaagacgttggcagggtgcatttcttactgaatgccttggggtggaacttgcttgcaagcccatttatgctgttggccatattcagttccttgagcttgtaggactgaggtgccctctttccttactggctgttagccaggagtcagtctttgttcccagaagctgcccgaattccttctcatgctttttatgtgtctccctccagcgagggccagttcttctgccacatctctctgatttcagctagagaaaatatcctgcttttcagggctcagattagatttagtgcacacagagaagccaggataatctctttattttaaagtttgtaattttaattacatctgcagaattccttttgacatgtaatgtagcatattcacaagttctagggattaggcacgagatgggcattctcctaccacagccgggaagagcagtttcagaggttgccttccctaggtgatgtgggtgttctcagttctcaaatttgtctgttttctctctagggttcactttctctctagggttcacgttgaaagtcgtgattcttggtgccttgatttattgtgctcatagggttaaaaaaagatttgcattagaattctagacatacctttaactcttaacttcctcccatgtttttacactgttgtttaaatttggccattttgggaaatgctttatacccaagtaatttatagttgatgaagggatagagaaagtgtcttgcttgtggcaccgtgactcacacctgtaatcccagcaccctgggaggctgagatctgggactacttgagtccaggagtttgagaccagcctaggtaacataaacaaatacaacaatcagctgggtgtggtggcgtgcactcgtagtcccagctactctggaggctgaggtggggggatcgcttgagcctgggaggtcgaggctgcagtgagctacgttcacaccactgcactccaacctgggccacagagcaagacccttctcaaaaaaagaaaaaaaaaaagcattctgagttttgacagagaagaaaacatttgatggttacttatctgtctctaccaagagcctagggaacaatgccccagagcatgagctggtatatagtctagtctcctggctcccactgagaaaaagggattttgagttgaggctggctatgactagacagccattgcagggactctccagttcagcctcttagccctccactgcctccacctcatctgggcccattctgggctgtggtctcctgctctcttcccagtcccatccttcttcccccaacagcacaagtgagggtgaggcctaaagtgtagccactgccctgctgcagaacaatcagtgacttttcttagcattagaataaaactccagatgtcccaccctcccagcccctcaccctgacctggtatagtcatctcttctcctacccccaccgtgttctgacctctctggtctttcagcttcttgaacattctaagctttttttttttttttttggagacaagatcttgctctgtggcccaggttagagtgcagtggtacgatgatagctcactgcagccttgacctcccagggtcaaacgatcctcccactgtagccttctgagtagctgggactacaggcacacaccaccacgcctgactgatttttatattttttgtagagatgaggtttcaccatgttgcccagactggtcttgaactcctgggttcagatgatcctccctactagccttccaaagcactgggattacagatgtgagctactatgcctggcccctgagctctttctttttaaccaatttattatcaagtgtttaaggtattgaaaaatgagtagactcctccccaccactgtattcatgactagctccttcttttaggtgtctgctcagtatcagatactcagaggatccttccctgcttgatctaaagttggtcaccgcctctgatatgttttatctcagccctttttagtttcccataggacctcatacctatgaagcttggtacctggtatacaaaacacttgttgaggagtggaatagtattttcttgggggctgtgtgagtcacctcttttttttttttttttttttttgaggtggagtctcgctctgttgcccaggctggagtgcagtgtcacaatctcagctcactgcaagctccgcctcccaggttcacgccattctcctgcctcagcctcctgagtagctgggactacaggcgcccgccaccacgcccagctaattttttttttttttgagacagagtctcactctggagtgcaatggtgtgatctcggttccttcaacctctgcctcccgggttcaagcgattctcctgcctcagcctcccgaatagctggggttacaggcatgcgccaccaggcccagctaatttttgtatttttagtagagacggggtttcaccatgttggtcaggctggtctcgaactcctgacctcgtgatccacccgcctcggcctcccaaagtgctgagattacagacatgagccaccacgcccggccgggtcacctcttgtattacagtggtattctttatttttttatttttttaagagacagggtcttgctttgtcacttgggctggagtgcagttggtatgatcatagctcactgcagcctcaaactcctggactcaagtgattctccagtgcagtggtattctttacctgaaccagtgtacattgtgaagctctggagcccctgctttctccacttgttacacttgttagcctttctttttctttctttttttttttttttgagacggagtctcgccctgtggcccaggctggagtgcattggtgcgatctcagctcactgcaacctctgcctcccgggttcaagcagttctctgcctcagcctccagagtagctgggattacaggcacccgccaccactcctggctaatttttgtatttttagtagagacggggtttcaccatcttggtcaggctggtcttgaactcccaacctcatgacccacctgcctcggcctcccaaagtgttgggattacaggcgtgagccactgcacctggcctagcctttcttaatcgtgtccctcatcaatgaaatggtagaaagccaatctgttttacaggtgtggtagaagggaaaaatgaagagacctctgtacaagcctttgcagaggtcttgggactcagtggtgagctccctgccaccacctcctgtgcccttgcaggagtaggagatctatagtcttggagaataagggtgataccccaataccccaagcctggttagggaaattgatgacccttattggagcctgtggggaggtagttgggaaattgttagtagcttcatgttggcattttcttttttgaaacagaatcttgctctctcctccaggttggagtgcagtggcatgatcttggcccactgcaacctctggctcccaggcttaagcgatcctcccacctcagcattcccaagtagctggtactacagacgcatgccaccaggcccagctaatttttgtattttgtgtaagagacagggtttcaccatgtctcccaggctggtcttgatctcctgggctcaagtgatccacctgcctcagcctcccaaagggctaggattacaggtgtgagccaccgtgcttgcctttgttgactctttattgaacatctactctccctgcagaaactgcaggataagccacccttagaaccaatttaactggcctttttggggcttggaccttcctcatgggattgctgggttaatgttgagcctgtctctgggctataggctctcagagaacaagagtgcatctgcaatgactagtgctgcacctgtcatacaggtttgtagaaaatatttaagctgtgaatgaacaaaaggaccttatcagctattttctttcaattctttttggtttttctgtgatcctattcttgagacttttatccctcccacccctctgtacagcagattgcacatataaagatgaaataaatagatgtccattgggcaaaacaatacagagaggaggtgacacagctggggaaggacagtccagtatctgatgaagtgccagaaggggcttagggggagcatggaatggagctggaactgccaggtcagccacctcttctagtgaagcctccagagagacgtgagctccaagtaagacaacacaaggaacaaaacatacaactgaacagcaacttccaagggtctggagaggtcttcagaaggatagggagtgcccttaaacttgcaagcccagattctgcctgtgggtcatggtcgtgccataggcagaagccagtgagtcagccttggcggagctttttctgtggcttttcccactcacagctctgtgcccttctggtgcagctccagcccttgttttccagcttcatagcctggttgtcacataaatggctgcactggcttacaggtgtctgtgtataacctattgctagaatgtccattccttgaggctaggggccctgtctgtccctctcttcactttcatagccccagtgccccatagggctgctcctgatgggcaaataggaagtggttgttgagcctctaggccagtcgtgacagtgacctgaggggacttgagccctcagtcatctgctcaggagttcagggctttctcaacagcagctgacgtgcggcaggcatgctatgccaagccctgttgcaggagttgacagatgttgactcatcccctcttcatgctttctttgtcagtagatgtacatgttactcacatttataagatgaggaaaatgagacctagaggagaggccactgctgcttagagttactctacatgttgtaaatcaggggtgtccagtcttttggcttccctgggccatgtaggaagaagaattgttttgggccacacataagatacactaacactaatgatagctgacgagctaaaaaaaaaaaattgccaaaaaatctcataataaagtttacgaaggctgggcgtagtggctcacgcctataatcctagcactttgggaggctaaggtgggtggattgcttgaggtcaggagtttgagaccagtctgggcaacatggtgaaaccccatttctactaaaaatacaaaaattagctgggcatggtggcgggcacctgtagtcccggtggggaggctgaggcaggagaatcgcttaaacccgggaggcagaggttgcaatgagccaaggtcgcgccactgcactccagcctggcgacagagtgagactcagtctcaaaaaaaaaaaatatatagaccaacctggccaagataataaaacctcgtctctactaaaaatacaaaaattagccaggcatagtggtgcacacctgtagtcccagctacttgggaggctgaggtaggagaatcgcttgaacctgagaggcggaggttgcagtgagtcaagatcacgccacttcactctagccggtgacagagcaagactctgtctcaaaacaaacaaaaaaaattaaaaataaataagtaggttgggcgcggtggctcacacctgtaatcccagcactttgggaggctgaggcgggcggatcacctgaggtcaggagttctagaccagcctcaacatggagaaaccctgtctctactaaaaatacaaaattagctgggcatggtggtacatgcctgtaatcccagctactcaggaggctgaggcaggagaattgcttgaacctgggaggcggaggttgcagtgagccgagatcacgccattgcactccagcctgggcaacaagagcgaaactccgtctcaataaataataataataataataataataaataagtaaataaatgaatggttgctgaaccacagcaggacaagacagacaaaccccttttatttgtttttgttttttggaccctaacagcagaggaagagccagccagcaagccccttttgatctttggcctctgccaaccagtaccccccagaccttaacccccagccctaccaggtcccttttgtaagtgaccccacatgcctaccacagttgcaggccctgacatccaccctgaccagaggtcttccagctattactggtgtttgtgatgctgtggctgtggccagtcaaggacccatgctgggcatcccgaggtaggaaggaccatgaccacgtgattatctccctgccactatcatggcagggctgtggggtactagcctcctttaaagcattccttaggacagtaatttctgttaaatatctggagggcaaacattttaaggaattttaatgaatttttaaaaattcaaaatgaaaaatttaaatcataaaaccaaatagaagaaagacccctatgtccatatacgcaccactctgcttcagtgattatcaactcttgtctcatgtacttgacctccacacaattattattactattttttgagaaagggtcttgttatgttgcccaggctggagtgcagcagtacaatcatagctcactgcagccaactcctgggcttaagtgatcttcctgccttagcttcccaagtagctgggactaagggtaggcgccaccatgctggctaattttcttattttttttttttttggtagagaccaggtcttggtttgttgcccaggctggtcttgaactcttggcctcaagtgagcctcctgcctttgcctcccaaagtgttggattacaggcatgagccactacgcctggccatccccagttattttgatgcccagactgttttagtggctgcccactgtctgtggattctgttcttagtcttgatccttcgtgcagtgtctgcacctgcctgccagttccttgacctgtgctccatcataccaagctggcagtggatcctcagacaatctcagttcttactccctgctctgtgtccagtttgtttgcctacctaaaagatccttccttttcgtggctgagcagtgcagccgttctccaaggagactgggccttctgctgcccccaccaccctgctcttttcactgcccccaccccgctgctcttttcacaggcttggtgaggagtttccaggttgcacttggtttgtttgaaggcttatctcctcctagtctgaactcgtcagggcaggagcttgaatcaatcatttcctgcctctcaggactgctgtagcagggggattcctagatctgtccagtgccagtttcctgagtactgctgcaggcccatttcagctgctatggtgatgggggctgtcctgaggggacattcacctcaggtagagatggcagaaacaccacaggaagatgcaaccagtcagctcagctgggggcacttaaattagatccattttttttctggaaggccttttggcaatactgtttatcccagtaccttaaaaatgtcgatttcctccaagggcgcaatcaggaaagtattcaaagcctgatggtgatgagggtgctcattgccgcatcattgtctcaggagtgggatttgtgaaacagaccaacagtgggagcttggttagagttgtagctgcaggtgatgggctctgtgctgctgttgacattgacgtgagggactgccataatgcgtcaacatcgacaagcgcttgttaccaagcaggatgcgtggtacaggctgagttttattaaacagatgtctttaactggtatgaatgattttaattttttctttgtttgagatggagtctcgccctgtcgcccaggcttgcgtgcctggtgacttctctcacctgggccctcaatgccagaccagccttcccaggatgattccatcctttccatccctgcaagggagcttgaggccctttccctttcagtttgatactgtccttccaagttacctttcttcatgttggcacgagagctttgtgccacaccatgccctttctggatgctgtagtgtctggctcttcctctgtctctgtgaccctcttccctggtgaagctttgaccttggcttcatcccctccagatgacccctgatggttagctcagcctgtggtggctccagagccctcattgagtgcatcctgacacgaactgaacagattaactattttttgccttgccaacagcattggaaattccttgagtgtgggacctggactcatagctctatgtctcttatagttcttagcacaatatcttggcctagatgaagtacataataattatatgtagggttgtggaaagcagtgctggctttaattaaagcctgccatggttttgtccatcagtgctgcctaaaccgttctgaacttctcattttgaacttttttccctcacagcttgtgatggttgattttctttttgagacattcatttatttgtttgtttatttggcagggtctcactctgtcactcaggctgaagtgcagtggcgtgattgtggctcactgcaacctccacctcctgggctcaagcgatcctcccacgtcagcctcccaagtagctgggaccacaggtgtgtgcctccatgcccggctaatttgtgtaattttttgtagagtaagggttttgccatgttgtccaggctggtctccaactcctgggctcaagcgatctgctgcctccgcctcccaaagtgctgggattacaggtgtgagccactgtgcctggccctgagacatttatttaaagacaaaggggagtacaggctagagaacagaggggaatagaatagcagccaaggcataattacctctaaaccatcaccccataagggagatgttcgcctcaactttagtaatgactctctttctagtctaggtgcagggctgttaatagaggccctgtgattgggttaagggcttgaggtacaataactctgttatttagggcagtgagtccttggagaagatgctttaccttctttccaagccccatgtctccttattttgagggtgtttttttttttttttcttgagacagtcttgctctgttgcccaggctggagtgcagtggcctgacctcggctcactggcctgaccttggctcactgcaacctccgccttccgagttcaagtgattcttgtgcctcagccttctgagtggctgggattacaggcctgcaccaccacacctggctaatttttgtatttttattagagatggggcttcaccatattggccaagctggtctcaaacttctgacctcaggtgatctgcctgccgcatcctcccacagtgctgggattacaggcgtgagccattgcatccggcctgaggtttttattttgagaatatttcaaatgtacagagagttgcaaggacagtaaaagcactcaggcatcctcttccctgggattcaccagctcattctcacttttaccatcttcccatactccctgggggcctcctccttctgggcttcgtttccttttatttgtttctgtctttttaattttaatttttttttaactagcccttctctttggcaggatttgttcacttttaatccttggccccagcagcttctctgagctctgcctatgaatctgggggagagataggggctcacacaagagtgaagtgtgagctggagggctgaaggggaatgagggacatctgggccaaaggcaggggaccagcaaggcccccacccctggaacttctgttcttcccagcctacgtaccccttgcttcttcttatgttggtgggctctgggggctgggtgaaagcagtgcttgtaggttaagaagtgactcatcccacgtgcccgctgcccttctcttctgttctttgctctttccaagcttcctttcagtcctcctcatcagacatgacctttgaggaagtgatgagtctgctatgtgtgagacagagcccctgttgtgaagtagaactcagggttcgtcctcagaagcctcggtgggtcaccatacgtcctgcaagtgctgtcagtctgctttgattcgtgtgagggagaagtccctgccaagtgctctgtagtaggcattcaggccaaccaaagaacagggcagggtcctgaggcacaggctcagagctcttgcttatttcatggggtgtttaaattgaggtataatccctatcacagtgaacgacacgcatacttccaatcttgagtgtgccaccagagaactgttgatactccccagatctgcacccagccagggcaaactgtgcaccactcttctgacttccatggccagccgagacatttggaatctctgtgcaatcacactctgtgccatctttttttcgagacagggtctcgccctgttgcccagggtagagtgcagtggtacaatctcggctaactgcagtctcgacctcctgtgggctcaagcaatcttcccacctcagcctcccaagtagctggtactacaggtgctcaccaccatgccctgctaatttttgtgttttttgtagagatggggttttgccatgtttcccaggctggtctcgaactcctgggctcaagcaatccacctgcttcagcctcccagagtgctgggattacagtcctctgtgcaattgtgtgcatcatgtgtgaaatttatcctcatttatcctcacaggcagcagttgttctattttttttttttttttttttttttttgagatggagtctcactctgttacccaggctggagtgcagtagcacaatcttggctccctgcaacctctgcctcctaggttccggcagttctcctgcctcagcctcccgattagctgggattacaggcacgtaccaccatgcctagctaatttttatatttttagtagagactgggttttgccatgttggccaggctggtctcgaactcctgacctcaggggatccacccacctcggcctcccaaagtgctgggattacaggcatgagccaccatgcccagcctgtgtttttgttttttttgagactgagtctcactctgtcgcctaggctggagtacagtggcgtgatcttggctcactgcaagctctgcctcccgggttcacaccattctcctgagtagctgggactacaggcgcccatcaccacacccggctaattttttttttttttttgtattttttttagtagagatggggtttcaccatgttagccaggatggtctccatctcctgaccccgtgatccccctacctcggcctcccaaaatgctgggattacaggcgtgagccactgcgcctggccttatttatttatttatttatttatttatttatttatttatgtatttctgagacagagtctttctctgttgcctaggctggagtgtggtggctcaatctcacctcactgcagcctctgcctccagggttcacatgattctcccacctcggcctccagagtagctgggactacaggcgtgcaccaccatgcctggctaatttttgtatttttagtagagatggggtttcgccatgttgggcaggctggtgttgaactcctgacctgacctcaggtgatccacccgccttggcctcccaaaatactgggattataggcgtgagccaccgtgaccagcctgttcttgtttatgacgtgttattccatggaggactctgttccagataactcttttattttgtgcctaatgaactttggtgttagttccagatgttggctacatgaaggcaaccccaggaatggctttggtcatgtcttctggtaaatatatgcacttaattctctgggctgtgcacctagaagttaaataaaggactgggtcagaggatgtgtctcttagcatgttctgctgaacagtgttcccaagtggtaccagtttacgttcccaccagcaaaatgtgagggagttccacttgctggacatccttgccaacacctggtattgtcaaggaacctgtctgtaacaggcactctcgttgattttgaatgcacgctgaaatttactgggtgcagtgacagtaggaagggaaaggatgattaaaaaaagaaaaaaggaatggaaaggctgatctaggagggaggaagctcataaggaaataagtggtaggatttggtgattccatgtgtgaatgctcgtattccgtgtgcatgcgtatatgagcttgcaggagaaagggaggagggaggcactggtatgcactccaccagttctcctgccacagcctctctactgatctgagggctgggtgtaaggtgatgatgtggggagtgggtgtgggtgaaatttccaacagtcagtgggagatgggggaagcaaacctgggaagagcagcctgctgcaggagcaagtgggtgggccgtcctggaggctggatgaaacctgtctgcctaggtggggatggcagaagtggcagagcagagaactccagagcagggctgtggtgggcagagcagatgtgaaggaagactgtgggatgagaggatggggcacggtggagccccatcagcctccagtcacagcagccccggtcccgtctctccctcctgttttggtcagtaccttcaggacttgtgggtgtagtacttcgttccattccggataacattgtagaagactgaaaaacaggaaggtgttttccatactctctccagagctggctgttactgacatattgatatatttccaccagtcttgtgtgtgcttatagcttgatatgtatgcattttaaatatgtaaatatatatacacatgtatttttaaagtgaaactaggctgagactgtgagttcagttttgagttataggtttcccatggcttaggttgtgttctctccctggatggagtctggctgggacctgcatgctcacagcccaggttcacatgaggtgtggatcatgcacaatcatcccacgggcttgagataagcatttgacttcctttttttttaaaaaaaaagttcattatggactttttcaagtgttcccagaagtagagataatagaaaagtggtctcccaactactttgagagttagcaacatatggccagtgttgcttcacccacccttcctcatcacctcctggactattttaaatcacatcccagacaccagatgatttcaactgtgagtacttgagtgcagatctctaaaagatcgagcttccccacccccaccaaataccacagagccatgtgagatcagcatttgggttggcagatctcctccttgccacatgcttgcctggtggtgaatgggacactttcaggcgagacctaggggagccccaggccagcaccaggacagagatctcgaggcctttccaactctgctggttcttcagaagtcaaaccaacagattggagtatgtgaaggaagctcgtgtattcttctgaactagcttagacaacagtacacagtttgaagggcagcagccttttctgcaggttagttctttcaatgatcttgtttactgggagttgagagaccttgaggatagaggcaagaaagcgtcatcaagcagcccagaggggtgtacagtgtttgaagtctcctgtattggtatgattcgagattttcattctgcaggaccaaaatacccattcctacatgtgggtggagagttaaattctgaagtatatatttttatcttgttaaaaaaacacttttatgtttctttaaaaagtaaaagaaccagaatgtagaagtttcagtaaaggaaaaagttacagtttgtttgggatacagtttgacaaatgtgctcccagctgcctgagagatagagaggccagatgtttgctttggttacattgatgactgaacaatcggtatctcatcatttcctgccttagagatgaaagcacctgggcactggggcagtaaattggttgcaggattggaagaagtccaaggacagtgtgggatgccaccctgtagctgtctagagacctagtgaaggtcagaaggctgggtgagaacaagccctgcactgatggaggacagggaaggggcttttctggctgggagtgtggtgaggcatttgagctgcagccagaaggcacctctcagattggtggggcttggggtgggggtgggaggaactgctttgcctgtgccgttggcctcactcatcctgaggtcccttcaaactccatccatactctgactgtggggccacttgcagaaggaatatgtggcaggttttttttgttttgttttgttttttgttttgagacggagtctagctctgtcacccaggctggagtgcagtggcacgatctcggctgactgcaacctccgcctcccgggttcaggcgattctcctgcctcagcttttggagtcgctgggcttacaggcgcctgccaccatgcccagctaacttttgtaattttagtagagacgggatttagtagagacgggatttcgaactcctgacctcgtgatccgcctgccttggcctcccaaagtcctgggattataagtgtgagccactgttccctggcctgtggcaattttttgagacgctcctgggggtccaaattgctaatagaggagaaacttactgtccctgtgttgactgagacaggaaggtttagataggtgaaagtggtctgggcgcagttgctcacacctataatccagcactttgggaggccaaggtgggagaatcgcttgatgccaggagttcaagactagcttgggcaacatagtgagatcctgtctctataaaaaataattttaaaaaattagctaggcctgtagtcccagctactcgggagactgaggagggaggattgcttgagcctaggagtcggaggctgcagtgagctgattgcgccaccatactccaccctgggcaacacagagagcctgtctcaaaaacaaaagaaaggtgaacatgagtttttttgttttttttttgacatagttttgccctgtcccacaggcgtgggccaccacgcccagctaatttttgtatttttagtggagatggggtttcgccatgttggccaggctggtcttgaactcctggcctctcaagtgatccacccacctcggtctcccaaagttttgggattacagacatgagccattgagcctggccaaacatgacctttctctttttttttttttttttttttttgagacggagtttcactcttgttgcccaggctggagtacagtggcacgatctcagctcactgcaaactccacctcccgggttcaagtgattctcctgcctcagcctcctgagtagcagagattacaggcatgcaccaccacgcctggctaattttgtatttttagtagagacggggtttctccatgttggtcagggtggtctcaaactccccacctcaggtgatccacctatctcagcctcccgaagtgttgggattacaggtgtgagcccctgcacccggccacgtgacccttcttaatagctattgttcgctgagtatttctctacgacactctttatgtgcattttgtcatttaattttaattttaattttctttttttttttgagacagggtcttactctttcacccaggctgtagtgtagtggcacgattttggctcgctgcagcttccgcctcctgggctcaagaaatcctcccacctcagcccccgagtttctgggactacaggcatgcaccactatgactggctaagtttttgtattttttgtagagatggggtttcactatattgcccaggccaatcttgaatcttgaattcctgggctcaagcatgagccaccacactcggcctcatttaatttttaattactttaaattttatcaacataatatatcacataaactgtaaaaagacaagaaactactgtggttcccattctgccagttctccccagaggtagcaactgcctttacatctgagctttcttccggcatatacctctgattctaggtaataggcacatgctgcttttgcaacttggcgttttacaaattatgttggcttgctctgtagctcccttccatcgccattatctctgcttctcctccctcattcttccagtattctactttctgcataaatcggtaatgaatgtttacattttctgcctacacaaatgatattcacagctgagcatagtggtgtactgcaattgcttgttatttttttcctaggaaagaattgccttttcaacactatgcccagttttctgtgtatctattcttattcttcctttattttccggttgcctctcagtacagttatcttcaggctcagtgctagtgagctgtcagtttcagttcaaacccctggcctcaagtgatccatccacctcggcctcccaaaggaggtgggcggtgaccctcttggacctcccttctggaaccctctaggcagtggccgcaggtgtggtgtgacagccctcagcgtgcttgtctgcccagactgggactgttgtcttcctttgttgggtcccttgttttctatatcctgtgtctcatcctttgtgatttattccctcattctgccagcttcctgagaagggactcctgggaattaactttctggagaccatgccagtttgagtgcatctaggccccctggtgggacatgctaactggggaatttaaaatgatgttacactgcgctgcccttgtgctggcttgtgcttctgtctcctgaggtgctagctctcagcctcatatgacttgtcttgatccctaaacccaagtcctgctctacttgggaagttcctttgagtcatttcaggggaatctcactccctacacttcctgtgctggagtgtttaatgttcactctttgggcctctagttttatcttttatctcctgttttctatctcttttacttttagctctcctctctaagtgatttcctcaattttttctttgacctttcactgctaacatgcttttatttccaagaactccttctttttccttttttgtaatctgacttttccctttttatagcacccattcctgttaaatggatacaatgtagtataatatttatatatattataataaattctaccgttttttttgataaattttcactttattgcccaggctggaatgcagtgatgtgttcatggctcactatggcctcgaactcctgggctcaagtgatcctcccacctcagcctcccaagtagctgggactgcaggcatgcaccaccactcctggcaaatatttttgtttttcgtagagatgggatcttgtgatgttgcccaggctggtctcaaactcctgacttcagctggacgcagtggctcacacctgtaatcctagcacttttgggaggccgagggcaggcggatcacaaggtcaggagttcgagactagcctggtcaatatggtgaaaccccatctctactaaaaatcaaaaattagctgggcatggtggcgcgcgcctgtagtcccagctactcgggaggctgaggcagaagaatcacttgaacgtgggaggcagaggttgcagtgagccgagatcgtgccactggactccagcctgggcgacagagctagactccgtctcaaaaaaaaaaaaaaaaaaaatcaaactcctgacctcaagtcatcctctcgcctcagcctctgaaagtactgagattacaggtgcgaaccactgcacctggcctaataaattctacatttccttcttcttgctgaatttctgttaccgctaaattactcttttcttgtggggtctttattggccatgttatggcgtctggctgcccttggctggttgctcactctgagagggaccctccaaagcctaggagtctcttccagcacgtggagcttgtcgactgggaacttcattgaaggctcatctggctgcagattctgagtccttcctccagaacaatggtccccaacctttttagcaccagggaccggtttcacagaagacaatttttctacagaccggcagatgaggatggtttcaggatgaaattgttccacctcagatcatcaggcattagattctcataaggagcatgcgacctggatccctcacatgcacagtttacagtggggttcgtgctcctatgagaatctgatgccaccacttatctgacaggaggcagagctcaggcagtaatgcttgcacaccctctgctcacctactgctgtgaggcctggttcctaacagcccacagacctgtactggtctgtggcccagggcttggggaccctgccctagagcatggtcttccagacactgggctgtgggtgaagacctggctgccagcatgctgctcactgcgatggaggaggctgatgggccagtgggtctcggcagttagcgtgcatcgatctagtcacttagaccagagcacagatgaccacacaacccacctctctcagtgtcctacctgtgccttttcaactgggtgggttggccccctagtccagtgactatccgtttcatgcttttccagagagtaaacctcctgtggtcacctggtgctggagtagctacccacagtgtaaagttggggagtgagggatgcagggatatctttcaccctctgtcccagagcacttggtgcagcctggcctcaacctggcaaagacctagggctgtcactgggtgggcgcaccccctcctcactgttacttaggactctggtttcttggtcctcttgctgtgtacgttaccactgggccatcagctttccagcttctaaaaggctgttgaggccaccatttccattcttcctggtttttttttctgtggttttagtcaggttttaagatggaagggaattaaatgtgcaggctttgttcctcatttcaacttggaggttcatatctgttatttatttatttatttagagacagagtctcactctgttacccaggctggagtgcagtggtgctaccttggctcactgcaacctccacctccctggttcaagcgattctcttgcctcagcttcccaagtagctgggattatggccgcacaccaccatgcccagctaatttttatatttacgtatatatttttttgagacagagttttactcttgtcacccaggctggagtgcaatggcttgatcttggctcactgcaaccttcacctcccaggttcaagtgattctcctgcctcggcctcccgagtaactgggattataatgcacgccaccatgcctggctaatttttgtatttttattttttatttttgagacagagtttcactcttgttgctcaggctggagtgcagtggtgggatcttggctcattgcaacctttgcctcccgggttcaagccatcctcctacctcagcctcccgagtagctgggattgcagcgcccaccaccttgcccttttgtatttttagtagggatggggtttcaccatgttggccagtctggtctcgaactccggacctcaggtgatccacctgccttggcctcccaaagtgctgggattacaggcgtgagccactgtgctcagctaatttttgtatttttagtagagacgtttcaccatgttggccaggctggtctcgaactcctgacctcaagtgatccacctacctccgcctcccagagtgctgggattacaggcgtgaaccaccacacctagtccaaatcttttttttaatatgggaaaatcttttttcctttatagtgtctgcttctggtgacatgcttaggaaaccatcatcctgatattgtataactctccttctgttgtcttgtggtcctctgtgatttaggtttttaaacacatagggtaaagggtcccacatacaagctgtgggctcctgtcccaggtgggcaagcaggctgcacacacaggcagcaatttactgggaggcttcttgggtggggtgaagtggagctgccaaaaatttattctgccctatgagagttcacttgattgatagatgttgtgtttctcaaaattagaaaattagaagaaactcacagaagtttccttcgagcagaacataaatcggctgagaggaatcatcctgcccccctgaggtcaggagggtgaatctgtgccccagggaggaacgcaccttcctgctttagacaccagcagaggacagagaagctggctgtcctgggaattcatgccctcattcagcaatgggaaagcagttggaccagggaagggggcctggcagtgtggcagggggagcagtggtaaagagggtggggtcaggggagaggcctcactgagaggggagagggtccttggtgggaaccagggcggttgtggaaggaagagtcagggcgtggagcagagcagagcgggagttggggtggggaggccagttcatgcctcatcaacatgcctgtgtgagtgtccttcttgcgggcggtggagctggcctcagggtacactgcaggtgactcagagctccaatgggagggtggctctgcctgagggagctgcacatgctcattgggccatcgtctgctgaggagggggcaacaataacctcaacacatggcggaggtgttttgggatgcatcctattgcacatttgggcaggttgttgcctgacttatttctttaacgcatacctagcacttcctgtatgtccagtgccttataatattaactactatcatcctcagggctacccgtgaggtcggcactgtccccaccctttgtgcaaaggaaggatagggaggcgctgccagatgggttgagggcagaccggggcagcttgcctcaggcctccctggccttagcaggctttaagtttgatgccctgtgctccttccctaggaagctcagtttgccagttttttgctttatcttagtctcattcagattacaaggactgggactggactcctgttgccagtttctcaatttggaataggaaggaggtgaggaacaacaggcccatgctgggcagaagccctgcagaccaggccaacagtgggcctctcctcactgcctggccctgtctgtgcaccttcgtcctggccacagcctctcagagcccctcctttatgaagaggttacgctttaggggagggagtgcctctcccaagacccagagctggtgagtggctaggttggaatttgagcccaggtccctcctcccctgtctgcttcctgccaggcccagctgcctgccccagcacacgccttctcccaggcaccctggcctccactgccaggacgtgcctgtttgaggcctggattcccccatggctgccacgctgattctccgttctgcacgtcgtgtcccatcaaaatgcatgacagtaccactccttgtgttaaaaagagccagttattgtgcctggcagtgatgactgcccactgcacacaaaagtggacgccgttgtctctgctctcagggtgttcttagtatagtggggctggcacacagaaaccagagattcctccaggaagtgccacagacatgggtgaggtggctacagggtttctgtgcagccgacagcaggggtgcctgggtggaagcagggtgggaggccctaacaggcctgatgggatagtcaggcaatgtgccaggtagtaggtcatcatccctggggccctggggagagtgtgtggggcaggcgcaggagcaggctcctcagtgggctcctggacaggctgcctgctctgctggtgaggagcgaggctcaaagcaagcaggggcctgggttgcttcccacactcagtggcagttgctcactggcagtcatgtgacctggggagctggcgagggcgtgggggtaggaatgggaacgggagacagaggccctttgggaggaattgccacagatgcagtgggagttggggcaaagatttgaactttggagaattaaaggtggcagtcagaaagtgaagggagttcccaagtttctgggatgggcacttggtgctgggagatgaagacacgaagagcttttcttgatgtatccctgctggctgctcaggcagggtcgggcaatgccattaagacacactgtgttctgggaacagttctggacagtaaggacatcctcagaccccttagtgggggagctccaagggcctgtaatgatgaatcggtcccctgggaggcttcagtctaagctagataccagttgaaccctgactgagtacacagacatagctatggcaaccagctagaccatggccaaaggcagagcattggagcccagttcacagcaagggactgtgtgctctgagccggtaacagtccttgtgttcagaggtctggctggtcgcaaccagggagtggcccccagcccccttcctcagctagagcgagcaccacccaggcagccttgggttctttggtggccgcctcataggcctgtactgtttgtgaacctgttgcttatgttggacaggactgtggcaggacagccatcaagggtcttcccttgtgagctgacaccagtctgctctttgtcctcctctggctggacaggccctcgtcttcccggcttgcttgtgtgggggaagagctcactgtgacatgtgggttctctgttctttgtctcaggctgtgctccttactccatgttgggggctgtctccttgtgtgatagtttcctttcatttcgtgacagtggctcgaagggttttgttttcaggagacagagactgaggagtagccattcgggtctggctgctcaggaaggcatgctggggatggcagcagagcccagctcagggagatcagaagggggctttgggagcagccagtgctgttctgaaggtgggcctgggtcctgcctgcagcctcccgcagcgggtgtgttaggtctaagggaggaaggaaggggacttgacctcagcaggagtgtgaaatgggtaccctcctggagtcaatgtccaggcaggggatgcctctgaaaagcgccaggccagctggagaggaaagggcaggcatctgcagggaagtgtgggggattagctgcagagttcctgggttctttttcgctttgtctctattttgtgacacttgatcttcaaactagaaacaggagcaaagacattttcaaaaatacagttgtcagaactgcaaaaccacacagggtctgttactggccaccaaacctgctgggcctccctgggtggatgctgtgggagagatgtgggagtgacatggcacagtgctgctgttctgagcggtagccttgctggaggagcgccttgccggaggagcaccttgctccttggccccactctgaccctccgaagctcatgtggaactggacatttaccccaactcggtttcctggtgttggcctgtcaagacttgcctgtttctggcctccagcttggtccatgctcctcaggctctgagtagctgacggtgcccacagtgtccatgtcatctgtgacattacccaggacaggacagggcccgtctgccagtacatcccctggtgtatggtgccaccttgccttcagctcaccaagcatatttcttcaacctggtcatcccaccacctcagagctattgcactaagctgtgtttctagatcttgtctctctgactgtgccaggtgtctctgctgcaccaagacagtgtctgtctggggcctgccagtctgctgacactctcaaaaacggccagtagcagctcaaaaggactgcttttgtatcaaagcctggctttgctctctgatcgctgctggtgggcacagagcccatctgtgtaactggttgtcactccccagactcttctgcacccttcttcctctctgactcctggccacatctgccacccacagcctccccactccttacacagccagcctccaggccgtcctgcttggcctgcaaatgctcccctgctgtttctactgctcttccctgagtctccctattggtcccagtgctttgggaggccaaggtggaggatcacttaaggccaggagtttgagaccagcctgggcaacaaagcaagaccctgtctctacaaaaaaagtaaaaaataaaaaaattagccaggcgtggtggcgcatgcctgtagtcccagctatttgggaggctgaggtgagaggatacttgagcccaggagtttgaagctgcagtgagctgtgtttgccccactgcgctgcacctgtgagagagtgagacattgtctcaaaaaacaaaagaagaaaaagaaaaaaggaaggtgggaagaacaagtatgcctttgaagggcatacctgccttgaggggcacagatgaggcaaccttcagaaaacaggcctgtgcagccacttctatcagaaatgctcactgacttcttggggcctagcagctatcgtctcagcctctgggtgtggagaccctgccccatgctaacctgagagcatgagtacagggtcctcccagcccacccatgcctcgcttccccaggactctgacccagtgccgcgcgtgagttggttgtcattatcctcctggattgttaactctctcatcttttgtggccctggtgacctttcttacttgtctgttccacacctggatgccttgtgagcagaaaccccttgctgcctcctcgcctcccttcaggcttcaggaagcagacagggaggtaggaactccaagagtgcaggagtctcattctgtcgcccaggctggagtgcagtagtgccatcttggctcactgcaacctctgcctccagggttcaagcgattctcctgcctcagcctcccgagtagctgggaccacaggtgcctgccaccacacccgactaatttttgtatttttagtggagacagggtttcaccacgttagccaggctggtctcaaactcctgacctcaggtgatccacctgcctcggcctcccaaagtgctgggattacagacctgagccatcgtgcccagcccaagagtgctttttgaatctagcagggtggtaggtcaatgtcattttgtttttctttttacattaagacagatgtatgcacctctcagcattaaacctcctttctgtgatgtctttaagaatcacagtcatattgctgtagccccgtctgtacattccttcagtttcctgaggttggctggttgctgtttggagtggtcagaatgctttctagcacgagctggactgggcctattcaattcactcagaggcaaggccccagagccctgacatgtttgcttgtttcttttttcttttgctttctttcttttttttttttttgagacggagtctcgcactgttgcccaggctgaagtgcagtggcgcaatctccgctcactgccagctccgcctcccgggttcatgccattctcctgcctcagcctcccgagtagctgggactacaggcgcctgccaccatgcccagctaattttttgtatttttagtagagacagggtttcactgtgttagccaggatggtcgtgctcgcctgacctcgtgatctgcccgccttggcctcccaaagtgctgggactacaggcgtgagccaccgtgctcagcctgcttctttctttctttttttttttttttttttttttgagatggagtttcgctctgtcacccaggctggagtgcagtggcgcaatctcggctcactgcaacctccacctcccggttcaagcgattctcctgcctcagcctcctttgtagctgagattacaggcatgcgcaaccacaccctgctaattttgtatttttagtagagacagggtttcaccatgttggtcaggttggtcttgaactcctgacctcagatgatccacccgcctcggcctcccaaagtgttgggattacaggcgtgtggcactgcacctggccacttgtttctttatcagcaagcccagggtgggaggccaggcaaggaagagacccatcccactggcaagaaggcaggcagtgagcacaccagagcagtccacccctgggagccacaggccaggcctttctaacagattcacacttgtttttgtctttctgtgtgtgagtgtgggaggtgggggtgggggtgggtggggcagcatgtgctgcattcgaggggtctccaccttaactgatgtacatggctctttatccccgtggagcagcagtgtgatgaaaaactcttcataggattctatctcttagtacaaaattgttggtaaatgggtttttaaagatatttttcacatttatgtggtctttctcttcttgtctctagctagaagtgaagttggagcttgtctctttgatcccacatataggacctgcattgtcccacatagggacagacccttgccttgggagggactgagagatgacttcatgtggccccttcattttataggagtaatcgagtctagaaccagggtgctaccatctggcagagttcatggggaacgcaggccactcagagagcaggaaatagaggccagctggccacccagtagtctaatgcgtacttccttgatcctgaactggttgtgagccatccctaggggcaacccctcccccgccccgtcccttcatgccagggctctctctttgcttcatggcgaccacctttcctgtcccttttttctgatcaccctgctcagtggcctgtcattgctctctgttgagtgccccttcccatatgcctctcctggacctcagccaggctggtgtgctggcgatagcaccttgtcaccaggggcagctgctatgcagggcctgttggccagggccctgcagcggtggagtcactggtgtgtgcaaacgtctcttctccttttgtgtttcagcgaggatgccatgaggaaagctggtgtggcacacagtaaatccagcaaggatatggagagccatgttttcctgaaggccaagacccgggtaaggccctagtaagtggagccactctggcagagagacttggagaggagagcatcacagactctggaacccctctgttgggtgtcctagggtgtaggggtggggtggttgctcatcgattgatcacaggcacagttggttttgcctgcagcagtctgggtcctcctgtgtgtccatggtacagggagggcacttgggttgcaggcccagcctctggccccagacctcactgccgtcaccttccatctgtggtcagcccctgtgaatcctacaggaagcttgctcaggcccctagctggtcctgtggaagggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcctttaatctgtgtgtgctccctgggacagaaccgttttactagaaatgaacaaaacacatattcacttgtgtgcacgtgtgtgtgcaaggcagagctgcaagagcacagggactgaggtggggtagagtgggctctgtactatggacacgtgtgactgaagtgggatagagtgggctctgtattatggatacgtgtcactgaggtggggtagagtgggctctgtactacggatacgtttgataagctttttctttttctttaagagctttatacggttcaccctttaaagtttacatttcagtggtctttaggatattcacagagttgtgtggccatcaccaaaatctaattttggaacattcattaataaataaaaagaggtgcagcttccctgtgttgcccaggctggtttcaaacttttggccctacgccatcctcttgcctaggcctcccaaagtgctggggtcacaggtgcgagccaccaagcctggcctaattttagaacttttttttttgagacagggtctcactctgtacccaggctggagtgcagtggcgtgatctcagcctgctgcagcctcaatctcccgggcttaggcgatcctcctttctcagtcttctgagtagctgggactacaggcatgtgccaccacacccggctaagttttttattttttgtggagacgaggtcccactatgttgcccaggctagtcttgaactcctgatctcaagctatccccacgccttgccctccctaaatgctgggattacaagtgtgagccaccatgcccagccttcaacattttttaaagaaactttatacctgttagcagtcacactcccttttccttcaaccctcagctaccacttatactttctactgctgtagatttgcctattcggaattttccatataaatataattgtacaacatatgggttttttttgtttgtgcgtgtgtgtgtgtgacagttttcctcttgtgcccaggttggagtgcagtggcacaatctcagctcactgcaacctccgcctaccaggttcaagcgattcttccgcctcagcctcccaagtagccaggattacaggtgcgcaccaccacacccgactaattttttgtatttttagtagagactgggtttcatcatgttggccaggctggtctcaaactcctgagctcaggtgatccgcccgcctcagcctcccaaagtgcagggattacaggcatgagccaccgcacccagccacgtacaatatatgtttttattttgcagctggcttatttcacttagcataatattttcaaggttcaaggtccatgaaccatgtttggtatatactttattcctcttttgttttttttagatggagtctcgctctgtcacccaggctggagtgcaatggcacgatctcggctcactgcaacctccacccactgggttcaagcaagtctcctgtctcagcctccttagtagctgggattacaggtgtgtgccaccatgcctggctaattttcgtatttttagtagagatgggttttgcattggtctggggctatgttggccaggctggtctcaaactcctgacctcaggtgatccacctgccttggcctcccaaagtactgggattacagacgtgagccaccgtgcctggccaactttattcctttttattgtcaaatattccatttctggatggccatatcacatattttatagccattcgttagttggtggacatttacatagtttctactttttggttattatgagtaagcagaacaatagttaatgtataaatttttgtgtgggctgtgttttcatttctcttgggtatatacctaggggtagagttgctgggtcataccctacctctgtatttgaccttttgaggaattgccagatgtttcccaaagcaactgtactattttaaattctcaccagcagcttaaatgaggtttcaatttctcctcatcctctccaatacttgttattgtctattttaattgtagccattataatgggtgtgatttgcattgttttgatctgcatttgcctagtgactaatgatgttgagcatctttttcatgtgctttttggccatttgtatattttctttggagtaatgtctattcagatcctctgtccatttttaaattgggttgttagtctttttattgttgggttgtaatagttctttatgcatttggatataagtctgttattaaatatataatttgcaaatatataggggggattttatttatttatttttatttttgtttttttgagacagtctcgctctgtcggccaggctggagtgcagtggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagggaaaaggctgtgccactctttctgaagatgacagtgtaggcagcctttccattttgtgccaaaaataaaattttaaatacataaatcacagtagtttctaggacaactgggtaactacatacaaaatattgaggttgagccccaacttcataccctatacaaaacttaactcaaaataaaaaacaccagccaggcatggtggcgcgtgcctgtagtcctgcctaatcgacaggctgaggctggagggtcacttgatcccaggagtttgagattacagtaagctatgattgtaccaacatgttccagcctgggtgacagagtgagactctgtctctaaaaaactttttaaaaaattaactcaaaatgggtcaaaaacctaaatttacaagctaaaactataaatatcttagaagaaagcagaggcgtacatcttcatgaccttggattaggcagtagtttcttagatatgatgccaaaaaagcacaagctacaaaaaacgtagataaatttgacttcatcaaaattaaaaacttgtacatcataggacactgtcataagagggaaaaacaacccatgggatgggagaaaatatttgcaaatcacatatcaggtaagggtttaatatccagaatacataaagaactcctacaactcaacaacaacaacaacaacaacaacaaaaagcaactaaaaaataggcaaaatacagccaggcgcggtggctcacacctgtaatcccagcactttgggaggccgaggtgggcagatcacgaggtcaggagattgagaccatcctggctaacatggtgaaaccctgtctctacttaaaatacaaaaaaaggaaaaaaaattagccaggcgtggtggtgggcgcctgtagtcccagctactcaggaggctgaggcaggagaatggcgtgaacccgggaggtggagcttgcagtgagccaagatcatgccactgcactccagactgggtgacagagtgagactccgtctcaaaaaataaatacataaataaaataaataaaaataaatgaaataaaaaataggcaaaatacttgaataaacctatctccaaagaagagatacaaatggccaacaaccatgtgaaaagatgctcaacatcactagtcattaggggattgcaaataaaaaccacaatgagatgccacttcatttccattataatggctatgatttttaaaaaagacaataataagcgttggcaaagatgtagagaaattggaattctctttctttttgagacagtctcgctctgtcgcccaggctagagtgcagtggcacaatctcgtctcactacagccttcgcctcccaaattccggtgattttcctgcctcagcctcctgggtagctgggactataggcacacaccatcacacccagctaattttttttttttttttttgagatggagtctcgctctgtcgccaggctagagtgcagtggcgggatctcggctcaacgcaacctccgcctcccaggttcaaacaattaccctgcctcagcctcccaagtagctgggactacaggcatgtgccaccatgcccagctaatttttgtatttttagtagagacagggtttcaccatgttggccaggatggtctcgatctcttgactttgtgatccacccacctaggcctcccaaagtgctgggattacaggtgtgagccgctgcacccagccaatgcccggctaacttttgtatttttagtagagacagggtctcatcatgttggccatgctggtcttgaactcctgacctcaggtggtctacccatcttggcctccccaaagtgctgggattacaggggtgagccaccgtgcctggcagagaaattagaattctcatacattgctggagagaatgtgaaatggtgctgtggaaaacagtatgacagttcatcaaaaaattgaatgtagagttaccatacgacccagaagtttcactcccaggtatatatccaagagaaaagaaaacatgtccacacaaaaatatatacacaaatgtttatagcatcattataacatcataaatagccaaaaatggaaacaacccaaatgtctaccagctgatgaatggataaacagaatgtagaatatccatacaatgaatatcatgtggccacacgaagcaatgaagggctgatacatgctacaacatggatgaagctaaaaacattacataaatgaagcagtcacaaaggatgacatgttgcatttttataaaatgtccagagaatacgaagatctatagagatagtgtattagtttcccatggctgccataacaagttaccataaagttggaggctcctatctctgggtccatggctctgacttctgagcccatgtctctgccctcactttcttaaagggtagcacatgtttgaggctgcgtagttttatcagcctattcctgcttctaaaattttgggagttcttctttgattttgcctagtctataaactttctactccaagctggcagtgtttctgctggtagaacattctcaaaatccttgtggaacttctacatatatgatggaattcatagtattagatgaggtttctccacagatctttcctagataatttcatctctcttcctcacttctgtgagatgattgaggggattcatgagtcccatgtttaatctctttggcactagaaaaatttggaagatatgccacacccttggcattctctacagaacacactttcctaacagtaaatctcctagttttagcattttggttttttccaatctaaatagcctgagaatttcccaaatcattaagtctagattcctttctgcttaacagttcttccctcaatttctctctcttctttgtgtgtgtgtgtgtgtgtgtgtgtgtgtgtgtgtgtgtgtatttttaaaattctttttattgtacccttaatttatctctttcatgttgcttttttttttttttttttttttttttggagacggagtctcactctctcgcccaggctggagtgcagtggcgtgatctcaggtcattgcaacctccgcctcctgggttcaggtgattatcctgcctcagcctcccaagtggctgggattataggtgcccaccaccacacccagctaatttttgtatttttagtagagacagggtttcaccatgttggccaggctggtcttgagctcctgacctcaagtgatctgcctgccttggcctcccaaagtgctgggattatagacgtgagccaccatgcccggcctcctcttgcattttactacaagcagaaagaagaaaccaagctgagtccttttttttatttttttgagactgagtctcactctgtcgcccaggctggagtgcagtagcgcgatctcggctcattgcaacccccacctcccaggttcaagtgattctcctgcctcagcctcccaagtagctgggattacaggtgcccaccaccacgcccggctaatttttgtatttttagtaaagatgggatttcaccatgttggccaggctggtcttgaactcctgacctcaggtgatctgcctgcctcagcctcccaaagtgctgggattataggcatgagtcactgtgcccggcccaagctgagtcttgaatgctttgattggaagtctgctcagctaaatgtgcaaacttattgcttatgattctgccttccacacagctacaggacacaatccagctaaactttttgccattatattacaaagatcacctttgctctagtttccagtaacatgttccttgtttcctttgtttctttagaatcacctttaattttcatgtttctaacaacattctgtttttgatagtatatgtattcttgaagataatacagactttctgtatcaagttcgtcatttcctttaaggcagagtctgggtgacagtctttaacatccgcatttctacccacagcctgttcaaggaaacctaggccttttctatcatgcttctcacaattctactagccctcctttgttattgagttacaaagccactgccatatttttaggcaccctactcctggtaacaaaattcgtatgtttcctgtggctgctataacacgttactacaagcttggtggcttaaaagaacagaaatttaggccgggtgcggtggctcacgcctgtaatcccagcactttgggaggctgaggcgggcagatcacaagatcaggagatcgcaaccatcctggctaacatggtgaaacccccgtctctactaaaaatacaaaacaactagccaggcgtggtggcgggcgcctggagtcccagctactcgggaggctgaggcaggagaatggctgaacccgggaggtggagcttgcagtgagccgagatcgcggcactgcacaccagcctgggtgacagagtgagactctgtctcaaaaaaacaaacaaacaaacaaatttaatctcacagttttcaaggccagatgttcaaagtcagtaccatgggtaaaaatcgcagtggcagcagggaggctataggagaggaacctgtttcttgcatcttttagcttttggtcactgctggtactccttggcttgtggctgtatcactccagtcttcaagtccagcatcacgaggtaaatacattctctgtattccatcttcacgtcgccttctctgtgtgtgtgaactttccttctgcctccctcttaggaggatacatgcaattgcacttggggtccacccgcataacccaggatagccctccatctcaagatgtttaacttcatcatatctgcaaagacctttttctcaaataaggtaacatttacaggttccagggaataggacctgatttaaggactgttatttagcctgccacagacagaaagttgattattgattgccaagggtgctgtagggaaatggagttttcatttggagtgaagatgatgttctaaaattaggccaggcacggtggcccatgcctgtaatcccaacactttggaggccaaggccagtggatcacttgaggccaagagtttgagaccagcctggccaacatggtgaaatcctgcctctactaaaaatacaaaaatcagtagggggtgacagcgcatacctgtagtcccagctacttgggagggtgaggcaggagaatcacttgaacccaggaagtggaggttgcagtgagctgagatggtgccacttcagcctgtgtgacagagcgagactccacctcaaaaaaaaaaaaaaaaaaaagaaacaaaatgctttaaaattgattttggtaatgctgcagaactctgaatgtagtaccaaaaaccattgaatggcatgttttaaatgggtgaattgtatctcagccagcctattacatatatttttaatggaacgagtgaaaatgatgaataacaggtctgttttcccttggtggccaggtcagggccgtgtggtttccttgggtggggggcactgctggggctgccttgtccctacttggtttctgatggtgtgtcctgtgggctggggccaaggtcccatggggctatggatactatcatggaaccactctttctggaatttgatggtatttcaaaatctattaggaaaactctgagacatgaaagcacagaggcgtcatattcctctaatctggagtcagcagttgctgtggtttggtgacttttcccttggctgtctctgtgtccctcctgaagtgtcgagggcacatccccaccctcagggttgtatctctgctgagcatctccacactggcctgtgctagggccccacctgacaatcacatggagtcactattgtcatcaatgggaaggcctctttcaagtttcaacgcttttttcctaatagttggcttctttgaatcaggatccaaacgagggtcttttctcccctctggcccctcccagcctggtgaaggagcagcccagctgtcctgcagccctccccatgggctctgatgtctcccaagctgctgattcatcctgcctgccccctccttcttatgaactgggtgctaaatcggagagcagagagggtgccgtggtcttttagcaaaaatatatccgaagtattgccttaatttgtatttctgggcatcttgatattcccataagaccacaatttggaggtttggagagcaacaacagcctgacccttgtaaagctcctattatctttccgatggtttcatcatttaattagggcttgtagactaattctggcttttctcccacattcgttacatggagttttttttgtttttttttttttgtcaagaaaggttttctttcgtcagccagggctagatgattgtttgaaaccctgtgtgttcaggacctccaggaatgctgtttttctgatctttccagtctaaggagtccccccaagggccacagatgggttctctttgagtgacattttgagctcagggctgtgtatctggggtgttctggtccattgctgtcattcattttgatgcttagatggtcccatcctcatctagcaggagctcctgtgtctcttggggccctcacacaacctctttagtttttcttagtctgctggcatttagacccagattggctgctcctctagggagtgaaccctggggacttctgccggtaaagtggcatttggagcatgctacgtgggcgctggtctgttcattgctttgggcctttcagtgaacagaactaagaaaaaacatgtttttgaaataacagcaacaacaaaaacccataattttacactaatatttctaattcaaatttaaacttatatatagggtttttacttctttcattttaaacatgtgtcttttctgttactatgaatatcttggtttctaatattattagcatacttggttgctttactttaaaatcatttcagaataaacagtttatattaccactgataacaaaaggtagactaaacatttaagattaccttgaagttctaattgtccttaaaatgtatcccttttattgagaacattttgctttttgtttcatttttttaaaaagcctctcaaaagatttcttttctctatatgattctgccaccaacttaatattcagctcatttgttttagtttatttggaatgtttaggaattggacctttttctttagatttgctatacttttcattttagaaaaatattttaggctggctacagtgactcacacctgtaatcccaacacttttggaggttggggactgagcaaaagacaagccggccaacatggcaaaaccgtgtctctccaaaaaatacaaaaaattggccaggcgtggtggctcacgcttgtaatgtcagcactttgggaggctgaggtgggcggatcagaaggtcaggagatcgagaccatcctggctaacacagtgaaaccccgtctccactaaaaaatacaaaaaattagccagacgtggtggcaggcgcctgtagtgccagctacttgggaggctgaggcaggagaatagcttgcaccacccgggaggcggagcttgcagtgaactgagattgcaccactgcactccagcttgggccacagagtgagactccatctaaaaaataaaaataaataaataaataaattagctggacatggtactgcatgcatgtagtcccagctgctcaggaggctgaggtggggaggctcacttgagcccaggaagttgaaactgcagtgagcgatgatcgcgtcactgcactccagccagggcgacagagtgagaccccatctcaaaaaatatatatattttttagagaaataaaattcactgagttgcccctgagttgcccaggctgaactcctgggtgtaagcaatactcctactttatccttccaagtagctgggattacaagactgtgccactgtgcctagctttgatttgttttttttgttttttgttttttgttttgagacagagttttcactcttgttgcccaggctggagtgcagtggcgtgatcgcggctcactgcaacctctgcctcctgggttcaagcaattctcctgcctcagcctcccaagtagctgggattaccggcatgcgccaccaggcctggctaattttttttgtatttttagtagagatggagtttcaccatgttggccaggctggtcttgaattcctgtcctcaggtgatcctcctgtcttggcctcccaaagtgctgggattacaggtgtgagccaaggtgcccgacttgatttggctttatcttctcaatagtaaaagatttatgtgcttctgaagtgaaaacccataacactgtggatttagagagggcacatttccagcccagttcctgatacttgctgggttgtcgattttcaattttggtgtatctttccagtgtttctcatggcagatttaagcaaatatgtgtgtttacgttccacaggtcttatataaaaggtgtatgtcatgcagtgtatgtggcacggagcacgtgtttctatcctttctccttccttgtgttcactccacaatatgttgtgaggcacttgtgcaagatttccacatgtcaagcaagtgtggaaattctatgaagcttttaactttttgaggtggggtctcactctgtcgcccaagctggagtgcagtggagtggtcacagctcattgcagcattgatctcccaggctcaagcctcagcctcccactttgaggccactggcgtgtgctaccacaccagggtaatgtttgtttgtttgtttgttttgtagagatggtgtcttactatgttgcccaggctggtcttaaactcctggcctcaagggaccctcctgccttggcttcccaaaatgttggaataatagatgtgagcctccacgattggcctctatggagttttttaaggtttctgttttcttatctgtaaactggatgtgttagtagtacctgcctctgggtggttgggagaaatcaaggcgataatgcatgtgaattgatgactcctgtgtctggcactgtaaagtgccaagtgctagctgttactgtcatgatgttcattgtttatggtttgtaatactcagcctcaggtacagctggacacttatattttgatagccagcaggggagctggagcagaccaagtgaagatagggagtttcctgactctttagcccttttttctgcagcagttctaggggagttggtgtgctttggagcagaaaggggcataataatctgtccatctggatgggggtgggggtggatggtgaggagtcaggagtgaaagagcccagccagggggatcagaggcgcagtttcagatccagggctttctcccctggaaaggagttgttgtggttgacccattgcgttcagcccctagatgttcctagataaacctgcctttgggggaatgtaggaagtatcatcgcccacaagaaagctccttggctggcagcatgacagcttcctgtgcttgtttctcacatcaggcgtcccctccctccccgctccccactaagcctcctcacgctggtctggtagcagagctggagcagatggcagtggctgcgcctactgtgggtcaggagtggtgctgggcactgcaggatgatgatgcctgcccactgcattccaggtgctgggctggcagtgggtcttgctcagccctggtgttatgcagaagggctttggtgacatggtcctgagccttgtttgagtgtcttatgtctaagtaaaagtatcttgttgcttttgaaacctacttccccttgttttaccttttatggatgtggagaaaacaaattcatttaaagtatcgcagacctaaaaaatggtccagggccttaggagctgtgaggtgttgacctggctggcccccaggcccttctcccctcatacatggccaccttgcttctgttcctgagtgtcctcaggttcccacacctccattgcccccattctcataccactgtccttcagggacaggctgcctgtgggcccccttcacacgcacatcagctttcctatcagtaattgatggggatagccggaagctgggcgtgttgacagaactgccttggtgtccccttgttctggccaggcctcgctgcttatcccagcttttcctctcccctgggcctttcttcttcatgttgtcctgtgctaattccccgagctgaaaaaaagaagtggggtagagtttggagatagatgtgggatgataaagatttcaaaagtgtctttgtatttttacactcatctgagaccacttttcatcatccttccctctgccctgccatcttatgagtgtagtggatggactctgagtgtcacagtgactcaggaggaaggttgggtgagcagggcacggagccggggctttgccccttccaggctgccctgccagaaggatgggcacttcagcagaagacaaggatgcttctctgaaataagactttacctcagacatccgtgtattgaccacaagaccaactcacagtagtgatttccctgaaacacttgggagtgagtgtccttggggccaaagaggacaatgggtgggaggcagcccctgccagacaatctcagaaacacagcagcttgcatatagcgggccttggcagccagtggccttcacctcacctgagagtgggcttcaccctctgccttgcctgtgcgtaaatggagatgaacacagattctcccggaaagcgcagccaggggagggccgcccagattttcagcagatactgcgtcatcagtgaaaaggcagcaacaggctgggctgagaaatgaaagcccttctttacagatagtgcaaagacacagcggcccacccacggctgcctctgacaggccttgtgccctcaggccagcgcctcatcacccccaacctgcctgtcccctttgtgatgaagagagggcactcaagatggctcccagctctctcagctgagtgcctttccatcaggggagaggagtggccgttggaggctctctgtccccttcttgtttctttgtgcctgttattggccagcctagctgagcactgacggctctcttccgagaggcggattccagaggaggccgagcaagcgtctgaatctgccttgcaggatgggcttcagctcggtgccagcaggcgagggggcgggaagggggagtccgatgactgcgcttcttcatctggtattaaactgcttcctgtttttacttttaggacgaatacctttctctcgtggccaggctcattatccattttcgagacattcgtaagtaagattttgcatttctgggttgttgagatctctgtgagaggccagccctgacgctgcctcggcagagctttctgggcaggccgtggtgcctgagtcagaaggtctgtgtcacctcacttgcttctgggaagttcttcactgccttgcatttgactccagatccctccatcctcccagagccttggcctcaaaaatgctgattctagcatcatggaaatgctgtcctcaaagtggtctaaacgggttgctgcttcacttgctcacttaatctcccttttcatagggctgttgtttttacttctgggaagttctgtttaccctggaacagaaactctcttccctaaaagttgattttattgacccatggaggccagagacacttaggcatattttccctccagactagaagcttctgaggaggacctcctgagtctgcaccctggctccctgctgtgctgagggcccccgtgttaacctcacgttgtgcctcctctgattcagagggcccagtgtggttctgtcagccaggcagtggccccagctctacagaaatgagttgtcattgcatcctagggccagggtcttcgtgcttgtgtgtgttacgtggaagtatgtggacaccaagtgttcctggatggccacagcctgcgaaggaaactggggccagcagctgctctgtgttttcagccaacaatggctcctgcccactgccgctgcataaccaccagaggcaggcttctcttgacacaggcctgtcgttggagcatgtgcctggcgagtcctatttctattcccctgtgggttagggacaggcagctgtaccttcagtgtgttgctgggtcaaagggagacattgagcactccagagcctggtaggttttgcttctttccacactaacttttcaccagaatggccagcaaagtgaacttcactgatctcactctctgtggtgttggaaagtcactgggatgtgtaagaggagaaggagcagcccagatgatctggcccagatgcgctggcagactccgcatgttctgctttcagggacagtggcctggctggtgcacacagtcctgtggggctcatgaggtcatgggaagcagccgagcaggaggctcagggccccatgactgctacagaagttctccgctgggcactggggtcagctggactggcttccagctggccgtggacagcctcagtttcctcatctaggtaacagagacactgcctcaccagagtgggctgcaaagggaggcagtgtcaagtcttggcaccactccagccccgccgtgggttcctgtagtgttctattatttgtttgctcagggctgagctgagactctggacctgggaaaaaggaaagccagagtaggcccagggtccccaaccccagagtgcttcagccttgggggcagctccctaaggccccaggttgaccctggagctactctgcaccctctgcccccaggtctcttgtggggtcagcgctgccaagagtagaaacacttcccccagtagtggggagtactaggagctccgtggggattaaggcttgggcaaatgcctacagaactgacctacccatggaaatatgtggttatataaaactatgtttactttcgtttttttgtttgtgttttcatatagataacaagaaatctcaagcttccgtcagtggtaagagttttcccttttgagttaaagtttctcccaactttggatttgaggtggcaagaatgacatagtgcatgcctcatgtgcctgggttaacctgtcactagaggagaatgcttgcggagagaactctggagggaggaggctgaccagctgtgccctgacctctccagccttcgtcttcctgcagactgtgaagtcgcatgatcctccccatcccgtttcacacaaatgctgcctttgcccagcaaaaagataaacactcacaaagctattaagacattatccaaaagtgttgagctctctggtagagaattattatgctgttttcagtgtaataatatgtagtagcatttctgagaaaatgctgtgaattcacttttttaagttacaaagtttctttgtaaatttagaaatctggctgggtgctgtggctcatgcctgtaatcccaacactgtgggaggctgaggcaggcagatcagttgaggtcaggagttcaagaccagcctggccaacatggtaaaaccccatctctactaaaaatacaaaaatagccgggtgtggtggcatgcgttgtagtcccaactactcaggaggctgaggcatgagaatcgcttgaacctgggaggctgaggttgcagtgagttgagatcgtgccactgcactccaacctggatgactgagtgagactccatctcaaaaaaaaagtttagaaatccatatttttaaatttcagcgtttatcacatgaggggaattctgtcaattcagccttggtctctgctgactaagctgcaagggaaggggtttaacagatccaggctggccaactgcattctgccattgggaagggagtgcactgacctcacaggctgcacgccactgtctgccctgccctagacagtagagctgtacatgccagctgtctctgcccatgtgggtctcacctctcagccaggacagggattcttggccaactggggctgagcggcagcaagggcatgtggccagaacatctgggccccttggcattggagcatggggtcctgggtaccacccagttgtgtggcatggcggtcctgccaggacatacctgtctgtgggtagctgtttgctgtgaagtccacactgttgtgacaatggcatccttgtccttggttgtggcattgctcactgagctgctgacctggtgggcttgggacatttctcctcagtgctctgtggagccctcctctgcacccctaagctgttctggcatggtggccctgcacacaggggcccaggctgagttggactctgcaacagcacgagtggagctgtgtgtgcctgtggacttgtgccctccctgggagagcgtcccctggccactgtgttaccgcttgctcagaagggcccatcgtgctttgtacgctcacccagcaggagggctggacagccaggagaggcaggggttgccacctgccctcaaggcctcagcccatctttagtgtatctgcaggcatcagagaggtcatttgtcccttaacattaggactctggtccaggccaggctagaggtatgggtcatgcagtgaccaacacacctggcgtcctagccattcatatttgggagtctccaggagcctagtctcttactgcttggggctgtgaggggattgagcctgtaggtaggcgagatctgtgctctgtgagccttacgccctttgagccatggtcagtctggtaggccctttcctgagaagctctgcccttgtgttcccacagatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagagtgagtaccacacttcttggaggatttgccgctttccttgcaaacgacaacacattttattcctgtgcttatgatggtatcaagaaaagcatggagaagctccaaatcgctctggtttttttgttttttaaatctttgttgtatgtggagagaaaaggcttccaattttcgttgagctcccagaagggttaagtgatgctgggccctcctcctcctcctagccctgggcaggagggtggggatggcctgagactccatccaaaggtttgtgttttgtggctgaaatagatacagtgtgtttcagagggttctcagctacaaggcagggctgagtgccagcaaccacaactccactgtctgcccgagctctgggcaccatctcttctagtgctgcccttgccccttggtcaccatgggtgtggcttgcagccatattatcttctggcttcctttctgtgaaggagactctgtgtcctctccacacggctgctgtggtgggaaactgggctgtgatcaggtgttataggtgaaccaaagctgctctaaaggggaggcaaagaacctccctcttctttccaggacctgtcttttgagacggggtctcgctctgtgggccacattggagtgcagtggcacaatcacggctcactgcagcctggacatcctgggctcaggtgatcctcacaccacagcctccaaagtagctgggactataggctcacagcaccgcgcccggctaatattttgtattttttgtagagatgggacttcaccatgttgcccaggcttatcttgaactcctgggctcaagcgatctgctcacctcggcctcccaaagtgttgggattacaggcgtgagccaacgcgcctgcccttaggacctatcttgatgtatccttgagtcccatcaacatttcttagagtgtgctgtgcccactgcaaagtgctttagtgtttttttcccctttcatgtaactttttatttttaaaataggagtcacaggaagttgtggaatagcatagagagttcccacatgccctttacccagctctccccaataatagtatcttacatagaacattgtcaaaaccaagaaattaatgttgaggcagtgtaatcacctcagttagagacttagcttggacttcatcagttttttttttttttttgagacagagtttcactcttgttgcccaggctggagtgcagtggtgtgatctcagctcactgcaacttctgccttccgagttcaagcagttctcttgcctcagcctccgactacctgggactacaggcgcctgccaccatgcccagctaattttatatttttagtggagatggggtttcaccatgttggccaggctggtctcaaactcctgacctcaagtgatcttctctcctgagcctcccaaagtgctgggattacagacgtgagccatcacgcccagccgacttcatcagtttttttacactcattcttgggctacatatatgggtatgtgtaggtctgtgagattttaccacgtgtcaaatcaagtagccatcaccacaattggcatgcggagccgttccattaccaccaaccaactctcttgtgttacctctcagagatcgcgccctccctccagccttaagcagtgacaattgctgatctgttgtgtgtctctgtagttctgtccctttgtgaatgttgtataaatggaatcataccatatgtgactttttgagattggctttttaaattcaatctgatacccttgagacccagccaggttttatcagtaattcattccttttcatcactaagtagtgttccatggaacggattttccacagtttgcttattcattcacccatgaaggacatttgggttgtttcctgcttttgcttactattatgcaaacaaagctgctgtggatatctgtgtacaggcttcagtgcttcaatatatttttgtcacacatccctcatgataaccctatgaagagggcagcatcgccccctctgctttgtcagtgtagcagctgctaaggagaactggagtcacaccccaggccaagagctgggatcgaagctgctgcctgaccccatcctcacactcctaccctatcctgtgtcaggtttcctcttctttggggccataggcatcctcatttctacccactcctgctctggaatcttcctccatcccaagccaccttcccttctcataccttaattctcctcttacttcctgttgtctaactctcagcacgtgctggtttcctcatcctagaacaatctgcctggttcttcgtcccaagctctcattacctcactatttttagcacatcagataagtacaccagctgggtttagggaggacccacagaagtgccggctcaagttccttgtcacgttctactcttgtgtacttggtgcattttttttttaatcatgagcttatacttgataataaattgtttttaaatgtatgagtttagaatgctcacatgagttgccttgtcatcccacttcagagactttgtcttaaaccagttctttgtcagaagttcagtggtgaagcttgatatcctgcccacgccctccccagtctggccttggcccccacatcctgtttttagcttccaaggggactggtcttctgtgtggcactagttgaaagttacagtgggggctgggcacggtggctcacgcctgtaatcccagcactttgggaggctgaggcgggcggatcacgaggtcaggagatcgagaccatcctggctaacacggtgagaccccgtctctactaaaaatacaaaaaattagccgggcgtagtggtgggtgcctgtagtcccagctactcgggagactaaggcaggagaatggcatgaacctgggaggcggagcttgcagggggcgagatcgtgccactgcactccagcctgggcaacagagcgagactctgtctcaaaagaaaaaagaaaaagttacagtggattctctacttcaggatcttgttaccacctttgtcagaggccaactctccctgcccttcaccacttgcctccctggtctccctgaaactagtagtgttgtctgatgggcatttgataccccttcctgacacctttcccaaagactactgcatgattaaggccctttcagatcttcatctagtgccaccaagaggacagagcctgggtcagaggttttgccagggactctcaaagggtaggccaggggacattgtgatagttttcaggtgacccaggttagtcggaaaaggctgaaactgctggttgttcctatggctggggctgcagtacagagttggaagcaaagcttttcactctgcgcatttttgtttctcatgagttttatatgacgtgcatgtaaagccgactttaaaaataatttctactgccagttgtgtgatggactggggtgctgaggacatgttctcctcctggataactaggttctggttaggatgcactttggaatgctggcctgcagcagttggggaggctttgtcctcctgagcctcagctgctgcaaggtgggggaagaaagcttgggattcctgtagtcagccaggatttgtgctgggtcctgtgtcaccccccataccccccagaagcaggtgcagattggagcaggtgcggattggaggaacatgtccccagtgtaagacctgtgacagttgcacattaaggtcaagcaatcagcatacaaagatcaccagccttgaagggaaggagagacaccatgaaggtgaacagaaaaaatagacacatgtaggcatgcccagtgaccacacacacaggaactgttagttatgggccatggggtatataaagaaataaagtggagagccgggcacagtggctcacgactacactcctggctactcgggaggctaaggcagggggattgcttgaggccaggagtttgaggctatggtgaactatcattgcaccactgcactccagcctgggggatagaacgagacaccatctctgaaaaaatagaaaacaaaaaggaaaagaaagagcagaaattcaaatgaaaaagcatcatcaggagcaatgaagcagatttgaaacggaaccaaatgaaagctgtagaaatgagcaatataattattgaacgaagaaagtggatgaatgaacagcgcattagatacagctgaagaaagaatttgtgtaatagaagctacatttgaagaaattatctagaatgtagcacagagaagagcacatggaaaatgtgaaagcaagggtaagaaatgaggataagatcagaaattctaattggcatccaagcaaagccccggaaggatcaaatggagagaatggaagaaaacaatatgtgaggggataactactgagaaaagcccatctggccccaaccaagttagccatctcatctgctgtgagactgcagagcaccaaaggccagaggaatgtcttagaaataggcagttcctgcaaaggagcaatgagtacactcagcagtagagtcagaaaggtaatagaatattgttaaagcattgagaatagagctgccagtcacatttgtatgccagcaagactcaaggatgtggaaagcaagccatttttagataaacctagccttagagaccatcactaaaagattttctaaaggatatatctttttttatcctttttccaataagccttttgcactcttagatatattcttttgtttatcctttcctcttccctctcaggtgatacaaggtaaaatgggaaaagaaacgttgagcataggtgatagtaaatgtgtataaatctaaagcagtgattctcacccagggtgacattccaccacaggggatatttgacaatgtctggagacattttgggatgtcactactgtgggggtgctgctggtgcgtaatgggtggagaccagaggtgctgctaaccatcttacaaatacaggtcagtccccccaacaacatagaatcatctgggtcaagtgtcagtagtgaaaaggttgaaaatcgctggtgtaaataaaaatttacctctgtaaaataaaacagtcaggctaacctccatacagacttgccacattccaagcactatttcatttcttttctattattattattattattattaagatggaatctcgctctgtcaacaggctggagtgcagtggtgcaatgtcggcccactgcaacctcgacctcccaggttcaagcgattctcctgcctcagcctcccaagtagctgggactacaggcgcgcgccactacgcccagctaatttttgtatctttagtagagacggggtttcaccatgttggccaggatgttctcgatctccagaccttgtgatctgccctccttggcctcccaaagtgctgggattacaggcatgagcctccgcgcctggcctattattattatttatagagctagggtctccttatgttgcccaggctggtcttgaattgctgggctcaggcgatctgctctgccttggctatccaaagtgtgagattacgggcatgagccacagcacccaaccccagggactattttgagtgttttacttacataatagattatttaattcttagtccagtgtgtggagtaggtactattattgcattttctaacagggaaaactaaggcaatgagcagtgacagagttgaggttttgagtccaggcagcctagcttggaggctgtatccctagcctcaaatccatccagcctcttaatagaatgtctgctgtgaagagttaaaatagatcaacaaaatatgaaataaatgcaagtcagcagggagatagagcgtgaatatcggttctgtcgggtacatataaaacctactttaaaaagtagtaaatttgggaaatgctaaaatattgatgaggtttatactttaagttaaatatgcatgataaaattgaaaaattattgctaaaacaatggaaataattcataaaatttaagatcaatagaaaaaataggataaggcagaaatccagataatacaaagttcaatccaatcatccaacaaaaatgcaatcaaaaaagacaaagaagcttagaaaaggaaagacaaaggccgggcgcggtggctcaggcctgtaatcgcagcactttgggaggctcagtcaggcagatcacgaggtcaggagattgaggcgatcctggccaacatggtgaaacgccgtctctcctaaaaatacaaaaagttagctgggcatggtggcgcatgcctgtaatcccagctacttgggaggctgaggcaggagaatcgctagaacccgggaggcggaggttgcagtgaaccgagatcacgccactgcactccagtctggcgacagagtgagattccatctcaaaaaaaaaaaggaaaggaaagacaaatattaatagaaaataagtttaaaaatataagtaatcataataaatgtgagtggactaaacttttctgctgaaagataggaaatgtgagaacaaatggaaatgaaacagcacagttgttttattgttagaagaaacacacacctacaataaaacatgcggaaggatttaaaaataaaagatgaagaaaggccaagtgcagtggctcacgtctgtaatcccagcacttggagaagctgaggtgggaggatcacttgagcccaggagttcaagaccaacctcggcaaaataggagacccccatctctacataaaatttaaaaattacctgtaggtacacttgagatgctgaggtaagaggatcacttgagcccaggaggtcaaggctgcagtgagccatgattgcactattgcattccagcctgggctgcagtgagacccaatctcaatcaatcagtcaataaaattagctgagtgtggtggtacacacctgtagtcccatctacttgtgaggctgaggtgagaggatcgcttgcttgagcctggaacgctgagtctgcaatgagccacgatggagacactgcattccagcctgggtgacagagcaaaatcccgtctcaaaaaagaaacaaacaaaaaaaaggatgaagaaagatgtattgggcaattacttcaattacatctctttgttattgataaacagaccaaaaaattcatttacagaaaatttgaacaatgtaatgaacaacttaatttaagcatatgatggaacaatatgtttataaaaataaatcataaagcaagcttcaacaatttcagaaaatttaaaagtattgtcatactttttgttgttgttgttttgagacagagtctcactctgtcacccaggctggagtgcagtggcgcgatctcggctcactgcaacctctgcctcccgggttcaagcaattctcctgcctcagcctcctgagtagctgggattacaggcacgtgccaccatgcccgctaatttttgtatttttagtagagatgggtttttgccatgttggccaagctggtctcaaactcgacctcaagtgatcctcctgcctgagcctcccgaagtgctgggattagaggtgagaaccaccgcgacccgccggtcatacatgttttatgaatgtcaaataaagttagaaatctgtcacaaaataaattaaaaattttttacacttggccaggcacagtgacccacgcctataatctcaacactttgtgaggtcgaggcaggaggatcacttgaacccaggagtttgagatcagcctgggcaacaaagtgagactgtctctataaaaattttacaaattagttgggtgtggtggcatgcacctgtagttccagctactcgggaggctgaggcaggagggtcacttaagcccaggaggtcaagggtgcagtgagccacgatggtaccacttcagtccagactgggcaacagagtgagaccccacctcaaaaaaaaaaaatcttacacccatcagaattgctaaaatgaatagtgacagcctcaagtgttggtgacagagaaactgaatcactcatatattgctggtgagaatgtaaagtggttttaccttctttcaaaatgaaatatgcaactcagcagttacactcttgggtatttttcctagagaaatgaaaacctcgcataaaaacccatgcacgaattttaacagcagctttatttgtggtagcccaaatctacagttacccaaatgtccttcatgtagacggttaaacacactgtgaggtgcttgtaccatggaataccctggcagtactgttgctagaactacaacctgtatgctgaatgtaaaaagccgatcccaaaaaggttcatactgtatggttccatttttgaaatattatgtataattttgaaatgacaaaattttagaaatggaggatgctgcagtggttgccagagtttgcgggtcagggttgctgagagaggtggcaacacgagggatccttgtggtgtggggactgtgtagtgtattgactggtggtgactgaacccacccaggtggttaaattgtccagaacttagtacacacacccacacaagtgagcacacatcgtggttgtgataccttgtaagtttgtagaatgttaccattggaggaaactgggcaaagtatacaaaggatctctctatatttctttaatacagctttattgagacataattctcattagcatacaattcacccatctgaagtgctccactcggtaggttttagtgtaatccacagagttgtgcagccatcagcacaattttagaacatttttatgttcaccccaaaagaaacctcacctcagaaaatcttgtaattgactgttcatataagcagttttcataatagccacaaagtagaagcagcgcaaatgttcatcacaggaaatcggtgtagtagaatattatttggcgataaaaataacacagaaaaactgataacatgccacgacatgggcgaactcgtaaatattatgctaaagaagctagtcacaaaagagcacatgttcgatgccattcgtacaaagagtccggaagtggccaatccatagagacagagaggagattactgattgccagagtctaggcttcttatttatccaaaagacttagttgtcccttttcttttgtctttggttattatagagtaactcatgataggaaatcccaaaatcaacacaaatgctacttcgtattctatctttctgtctgtggtaaatggaacgttcagattccagcggcagccgtggcagtggggcttttgctggctgttttgtcccttgctgtgcagccctgcagcgtttctgggaatctgccctgtggactgactggcgactctggtcttttctcagcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacaggtaccaggtcccctgttcctgctcttggcctccctcctgcagcgtgagccctgggctggcatcagccacaatgctgggtgcagtgcccggagccagccgagggttctcttgacacgtgtgcctgcccttttccatgggcttctcaaaaagtctgggacaaggccgggcccagtggctcatgcctgtaatcccagcactttgggaggccaaggcaggcggatcatcaggagttcaagaccagcctggccagcatggtgaaaccccatctctactaaaaatacaaaaaattagctggacatggtggcgtacacctataatcccagctatttgagaggctgaggcaggagaatcgctagaacctgggaggcggaggttgcagtgagccgagatcgcgccgctgcgctccagcctgggcagcagtgagactccgtctcaaaaaaaataaaaataaaaaaggaaaacaaaagtctgggacaggcaggagaaacaggccctgactcactaggaaggttctgtgatcgagcccttccatttgggcttgggcatctggcggtgggcctcctgtgtagttcaggggctgcgagggattcaaacaagagtgagctgaagcaagaagtgagacgaacactctgaggcttgggactacttgagccattgtgggccattttggctgaggacacatgtgcctcctgtttacctctgtgtcttgggttctgggctcagtgttagtcgacctccagctggtgttgcatgaggtgatggtgatgtcatgttagcagcactgcttctcagaagttgttcagcttcccatggtttccatagagagtctagacgtgttaaacatctgccctcacagcaggtcttggttgggagaggaaagccccaaagggccccaccaccctcccaccccttcaggcctcagctagctgggcttctctggatcttggcacccctctcccagagctgacagtgcatctgcagccacacttttccttctcctgctgacaagcagaccttgaccgtcaccgtgaggctcatgccactgacctataggggcaaagcaagcatcgttgcagaggcttcagaaatctgcagttgccccagcttttatcctagcttccatggagctgtacctattccttgtcatcttttgctgaagtttctaggtatgccctttgaaccatcctagtggaatggtagaccagagcccaggcacacacttggtgcctccccggtgtcaggaaggcagctggtgttggcctcggggggcccagagcctttctgtgggagatgtgcccctccccgtgtgagtgagaggtcagcctgtcagcccaggaaggccttttttttttttttttttttgagacttttttttgcctcttactctgttgcccaggctggagtgcagtggtgtgatctcggctcactgcaacctctgccccaccagtttaagtgattctcctgcctcagcctcccaagtagctgggattacaggtgtgagccaccatgcctggctaatttttgtattattagtagagacggggtttcgccaggttgtccaggctggtctcgaactcctgacctcaggtgatctgcccgcctcggcctcccaaagtgctgggattacaggcgtgagccactgcacccagccaggaaggctttcttgatggctctgcagatggccacctgggcttcctgaggcccagactgtcacagggaggagctggtgccacagaggcagatgagtgataaccgagtgctgcttgttctgtctctagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtgagtacctgtggcccacagtggagcacatgcagcccgtggctctgtcagcagtagtttctaggctctttggctagagatagcatatcctattcttcaagtgctgagacttcaggcagcccccaccccttgccagccctgccgactctagcatggctcagcagggaagcatgtgttttgcattttgtgttctgagagctgcttctgcaccccgcacagggtactgctgctgctactggggcaccaagtcgcattccaagcagtgtggctgattgcagcagttctgtgggccctttcagggtgtgagcacttcgactgatgagcaccacatgaaaggatgtgccagctccgtcagtgtctggtggtttgccaactactcagagttaatgttctaagcaaatatctttttttttcctttacactctgccaagtctcaggagaacaaagttcattactatatttttgagaggagtattaatataaaatactgttattcctagtttcattttgtatctctgcacaaagccagtctactcagtgacaggcacagaggacagagtatgatcaccaggatgaaggtagctgcatcaaggggccatttggacaactctttggctcccttggtttttgtggccttttctgtttgtgattcatgagtggaatggggcctgaggcaagtgtgggggtgaacaagaggcctcataggcagactggaagtctaggagagttgtgaggagcagatatgctcactcatctgtcacctgggagtcgacacactgcctgaccccggggactgtgcagactgaaacccttgtgtgctgcatggtggaatgtgccctggcagggtttgccctagtggcttggagatgtctaaggaagagcccgctgcatgttggaatgtgccctggcagggtttgccctggtgacttggagatgtctaaggaagagccccctgcatggtggcgcgggcctgtctcgtccttctggaggcccctccatgcagtggctccacagttgccccttttgcccaagtttgccccccacccccacttttttcttttgaagacagggtctctgttttccaggctggagtgcactgatgtgatcagacctccctgctcaagcgattctcccacctcagcctcccaagtagctggggctgcaggtgtgcatccccacacctagccaaatttttgtatattttgtagatatggggtttggccgtgttgcccaggctagtcttgatctcctgggcttaagcgatccactggccttggcctcccagaatgctgagaatacagacaggagctactacgccctgccctctgctggccggctaacccagctttccttcaaggaatcaggctgagtgaagctcttgtggaccatcagcatgcttggcccagaggatgagcaggctaggctgtaagctctgcattggaagtcgtcagtgcttgtgatagctggtgctgagggatgtgtggagacatcccagtgggagggccacattgccacttgccagaattggatttgagctaatgggatcctagatggccagtaaggtgacatcacagcacatgaggtcatgaaagtcccattcctcacctcaagaaaggctccatttcctaagcttccacaggaagactaggctctgctctctgacccaggtggttccaaatcacattctctctttctccctcaaggtccgagctccgatggtggtgcagcagcccccagtgcagccccaggtgcagcagcagcagacagcagtacagacagctcaggctgcccagatggtggctcccggagtccaggtgagggcctgggggtggagggctccatagtcatcagcaggtgcatgttcacctgcgcatgtagtgctacagtgagggttctggttggattaggggctgggggctaagttggtaaagcaggggcttctctcccccttgcactctgcaagacacccctggagtccttggggtgggcagctgtgcttggtcatgtctaggacccaccagccgcatagtgcgtgtcgtttccagctttgctcgggcatccttcattatccctcttccttgccactctgagtgactctgggaacatgtatcagagagtagaaggctgcagttttctcctcacctctcatcttccatttgagagtctgagtacagagctgaccagggtggagggcagctttctagacactcggaagcagatgggagccacatgcagcaggagcgtgggagaaggcatcctggtgctcgcctgcactcagggactccggcgctgtgtggtgagaagcgtgccactcccacattgctgagcttgctggtgtgtcacatgtgtggaatgtgtgtgtgtctctgtgtgtcacgtgttagtggaatgcagatggccttgtctggcctcctagtgtcctgggattggaggcccagggtttctgtaccttttcctataacccctcctctccttcttgtggggagacgtacagtctggggcttcagtttttcctcttttcacatgatggtggaaacactgttggtcctgactcggaaggggcgttggctttagaaagagtcagaatgtgctagttgatgtggtaagactgtggctgggtcccagcccacagctggcagtgcgcctgcactttgctgtcgtcttaagggtacctggccttgtggttttctgcaggcctgctgggcgcagcgcctgggtgcacagtgcctcgtggcaggcttcatctcacgcttggggggtgctcagtaatgtccttcatggtgcctgctacctcttttaagtccctgggaagctgcctgaggagggaatctgaggtatttggctgcagctgaggttagcatcctaccttggcagggcaccaaatgacttggggccagggtccccatgtcacattcttacttagatggagccctgtatgaaacacaccacagaactcacatttacttacagctgggggaggctgaccacttcgtgtgatgaggttggaggtctctgccacctccctgtgtgtctcggcatgtcctcaggcctcgtgggggggctcccttgtcctggtctcatgcagaggaaggacgtggtgtgttcagagtcagcttagtggtggcacatagtgactgcccacccagtggaagctgctacctttgcctctttggaccatcgatcctctgttcaggacctcacttcctggaaactttttttattttttgagatggagtcttgctctgttgccaggctggagtacagtggcacgatcttggctcactgcaacctctgcctcctgggttcaagtgattctcctgcctcaggttcccgagtagctggaactacaggcgcgtgccatcacacctggctaatttttgtatttttagtagagacatggtttcatcatgttggccaggatggtctccatctcttgacctcgtgatctgccggccttggcctcccaaagtgctgagattacaggcatgagccaatgcgcccggctggaaacttctgtaccgcaggtcaagcccagcaggaaagtgagaactgctcttttctttatttctttctgtcttttttttttttttttgagacagagtctgactctgtcatccaggctggattgcagttttgcgatctcggctcactgcaacttctgcctcctgggttcaggcgattcttgtgcctcagcctcccaagtagctgggactacagttgcacaccaccacacctggctaatttttgtatttttagtagagatagggtttcaccatgttggccaggctggttcgaactcctgacctcaagtgattcacccgcctcagcctcccaaagtgctgggattataggcatgagccatcgcacccagcctagaacttctcttctcttctcttttttctcttttcttttctttctttctttctttcttttttttttttttttttttttttttttttgacagagtcttgctctctcacctaggctagagtggctggagtgcagtggtgcaatcttggctcactgcaacctctgtctcccaggttcaagtgattgtcctgcctttgctcccaagtagctgggactacaggcatgcgccactatatccagctaatttttttttcctcttgtatttttagtagagatgggccaggctggtcttaagctcctgacttcaagtgatccacctgcctcagcctccctaagtgttgggattacaggcgtgagccactgtgcccagccgaactttccttttctttccatttcttggtatttggaaagtgaatagccatggagcagccagtgttttcagctggtgcaggcccagctggtatgttcgttaggcttctagctcaaggaagtgtccactctgcagtctcactggcatcccatcaccgtccagaagcaggatgccagctgtgtgtgctcatggcccatgctgagcctgtccttgggccactggtcttcctgtcggtttctccaccccttgtttcaggtggaggtccccgcccgactggcacaggaaggaggatggagagtggttaccactgtggttcgttgctgagtgagtttgatgttttaaggatcattgcccacctgccctgtggcaccatgtgctgccatgcaggggattcccaagtgctagtggcagaggagccttgtagtttctcaaagtccagcagtgggtagggcgtatctatgaggtgcttctcagtccagatgtggcaccttgaaattctgtaacccgcattctgctggttttctctcagagcttggtcttgccttgttgcaagcagtgcagtttcttgggggctaattgggcaccctcactgccttgttccaccaatagcagcgccccctgctgggggatggggagggttgggcacagcaagccctctgaggggccatctggattcatgatcttcttttgaaacttgaattggcacagtgaccagctgaggctacggtactctgatctaaaaactttaaaagtatgtgtggtaactgtagaacccagaaagtggagaggaacagaagtaagagaaccattccatgagagagaaggtctggtgtcctttctggttgtttcccatagtcaaggtcatgctatcctggggttttttgtgcagcatcttccacatcaataggggatgaaatgttctcctttaattagaaagccctggtcggcacgaaggaactcttgtcatacccctctgtgaatgtctcttgccatcctcagttaccatcttgttcttggaccttgtaataatttccgattttttgctattaccagtgacacatatcttgatgtcttagattgttcctggagctgatggaggtgagtgaatggttcactttgagggccttcagatctgatcagccaccctctaaccaggaggtcagagatgcagattggagctccccttgtgttgttcacacagtggacatcaggacgtggtgaccacgtgttgcagctttgtatgtatgagctgccgcgtgctgcggaaacaggcctcttgagttcatgaatgaaattctgggattgggggcccccatgcaggcagccctccatgccctgtctctcaagcccatcttagagccgaagagaggcgccctgtcaggcccttgcagtactgtggtgttggatgtggtaaagggtagcctgggactgagtattctagaaaaattgctcagccttgtgctgtgcacacctggttctctttccagtgttatttatgtagctgagaagggcaatgtcacccacaaggggatttagcaggacacagcagacttctttttctcccctataaaaccaagacatgcaggcacagtggctcatgcctgtaatcccaacgttttgggaagccaaggtgagaggatcacttgagaccaggagttcaaaactatcctgggcaacacagcgagaccctgtctctacaaaaaaataaaaataaaaagttagctgggcggagtggtgcgtgtctgcagtccctgctactcgggaggccgagttgggaggatcgtgcaagcccaggggtttgaggctgcagtgagctgtgatgacagcattacactctagcctgggagacagagcaaaactcttgtctctttaaaaaagcaagaaacaggacagaatgcatctcattttctttttttttttttttttaaagacagagtctcttgctctgtcacccaggctggagtgcaatggtacagtctcagctcactgcagtctccacctcctgggttcaagggattctcctgcctcagcctcccaagtacctgggattacaggcatgtgccaccatgcctggctaattttgtatttttagtagagacggggttttgtcatgttggccaggctggtcttgaactcctcgccttaagagatgtgcccgctttggcctcccaaagtgctggaattacaggcgtaagccactgtgcctggccatgcatctcattttcaaacagtccctatacctttgtcatttaacgttctattcttttagtatgtgaaaaccaaactctaatttacaagtcacaaagaattatccaagacagactcccattgtggacatgtatgtggcattgctgattcacagctactgtactgaagccttggccaccctggaggaccctctctctttttgctggacccttctgcacagtgactgcagtagggagagtcagacctgggggtgggggagaggttttttggattcctctctgggtagatgtgtgttgggaagtagtgaaatgttgatagctgcctggctcatctgatccagtaaacataactggtgcgtttgggttgaaagaaattgggctttccttatcagttctcagttataagaacatcagtcagcagtacattagacttaagctttgcattccttgcgtttttttgtttgtttttctcttcctggaaaaaagtttgcttctctcataccatctgacttacttccaggcttttctcccttgtggaacgagtgccgttgagccctgctgcactctcagacgggctcctccgaagtgccgcaggtggtggtaaatcgactctcacccactggggtcgctccttcgtgtctccccccggtcggttcatctgttgctctggctgcaggaggaacgagtgagcttctggtcggcgtctgccatgccgtgtcaccccggcttctggcacctcctgtgcgtgcccaggattgtgaatgtgggccgtgtgtgtgaggccacgggtctccctgcagccactctcctgctggagctctgttactggcacctgtcgctgcctgcaccgaaggctggcagcacctcctggagcttgggacccagagcacagcctcccaccatgagatgtgttgtttttctgtggatcagtcctcctttctttctgagcctggcgtgttttgttctagtttgttaccgtcctaagtgcctgtaggccctgctctccagggacgagactcgggctctacccccaactcagaacccagagcaagagtggtcgggcccgggcccacaacagtgctcagctgtcctgctgcctttgtagttcaagaagtgtccattgatgaggggaatggtcctggctcatgctggagttcctgactcgcatccctgtggagatgaacttcctcgtcagggcggaggcctgccaagcagtccccccaggcttctcttgctcacctttgcccatttttattacgaaagaaaaccagttccttgatagataccaggaccatcagcctcaggcctggaggaggagaggaggatgatttgggttcgggctgtaagaggtgtgccactgagaaggagggatgctgtgagcaggcttaactgagctcatggttcagtgggagttgagtgttctcatcacaggctttggtggaatgtactcttgacatctgtccccaggagcctggtctccagaaacaccagctcaggccctcaaggtctggctctgatggttctgtgggctataggattctgatctgttagcgaggtgtgttcagaagtgtgttgaggacaccagtgcaggagagcaaccagtagaacagaaaggtctggaagcagcattcttggcaaatcttctagattcccaatgcccagacagacctggaggtgctgtgggcttgaacatgtgggtggcctcccctcccaggctgccccgagctgcccaagctttccttgccctggtgctccttcttgcagaggctacacgtgccctctccacctgcccaggcactgagtttctttgttgcgatcaccttgtctgttgtccctctgtcctcaaagatgatcacggaagccttggcccaaggtgggatgcacataagagcccggttcccgcctaccaccgctgtgtccgccatcccgtcaagctccatccctttgggcagacagcccatggcacaggtatttacggggcagcgcccagggcacggctgggagctcggggcgtcctctgagcgcctttgtaaagcgcacctgtcattatcatcgccggtgacttcttttatggtggctttcagagtgccaaacccacagtccctttttttttttttttaaatgaagccaagcccagcttgtgcttgttgagaggatatgaataaatatctgggtcttttcagcttaaaatagttatactgtacgcattttcatggtaaaaataaaacagcagctaagcaaaagttttgctttctagagctgtgctatctaatagtgtagccactaagcatgtgtggctgtttacatttaaattgactaaaattaggccgggcacaggggcttatggctataatctcaacacctcaggaggccgagatgggaggatcacttgaggccaggagtttgagaccagcctggttcacatagcgacatactatctccaattaattatatacattttttaatggaaaatatatatataaatgtatatatattttaaaaacaaaaaaaaaacctaaaagtcaactaaaattaaataaaatgaaaaaatgcagttcttcagtcgcaccaaataaattttaagccctcatttgcccacagggaagctagtggctgctgcagtggacagcacagactccagaacgtggccaatgtggccaaagtggtattgggccatgctgttgtagagtttgatgtgtagagtgtgtaatttgtaacacagatcccctttctaggtagaggtagacttctgtgtacattatgcttttcagagacaggaattcccggcttcttttattgtatgaaatttggaattactccatggcatagtcatttttttaacaaatagttaccacatgcattctgtgtgccaggcactatgctaagattctgagaataaaattatgctgaagttctctcatcatacaggctttccattttagtgggtttgtcgtgaaaacatcaaatttgccaaaagaactttacaattcagtttctgttttaggggaaatgcctctataatcctagcagacagtggtccctgtccatccctgaacgcccaggtgcaggcactgccaccaccctggcttgtgcagtggcgtctctgcagctctgttctacacaggaagaagtggaggctgagccaggatggcccttggtccatgtggccccaagcctggtgccacacaccacacactgccaagaaagtggcctgggcccccactggggcatgtttagcttttgccttccctgcatactaaccccctgggttaccccagatgtgccattcacatagttactgactggaacttagtttctttggcagggacttcctttttagtagttgttgaattacagcgggaggaagtgcctggaatctgctggtagaaaggctttggtgaaagagctctccagaggagcggaagttgggggtcaggaattaggttgtgtggctgtggtggaaaggaggccagtgtgggcagaagccagggtgcagttccccatggcctggaggctgtgagttccacgacctgctcacatgctgctggtgtctccttgactagacccctttgggttctgcactcttgtctgctaaaactgcttctcctcctttcccatagcctctggcacagtatccactgggttcacagaatcaggttgggttgctgtatgtggaggaatgactttagtagcagcatgtaggactgatttttataaacacaaaaagtccccaatgttttcagtgtgcgatatgtgccaggccttgagctaagctctttgtgtacagagcctcactgtttcttgttgtagcaggtcatagtttgagcatttagccccttttacagactaagagtgcccccagggagccaccaagtcaggatcgagggctcaagtgaaacccttatgccttggcctctcagcaggattcttctggaaactcctcactccccttcctgctgggctgatgacctggcttctccttcttgtttactgggcactcctgggtgggctccctccatgcccccacaagaccaggctctgtcctgggctttggcttgcccatactctgttgtgggctggccactccccacacccagctgctggtgtttccacctagacttctcacaggcagcccctccctccctccctccctccttcccaccagttcccaaacccactcagtctttccctccccagccttccctggcccttagattaagtctgccctgagttatgccagctaataggtctctctctctctagaagcttccaacccccaaaggcaaggaggtaaggtggagcagaggaaggatagagaaatatatgatgaagctgaaaaagttattgccttggaataaatgccatggagaattctggtttgtcctcattgcactgtgtggggtgagagcgctctcatgggaagatgctggctaactgcacacagatttaatcaccaggccccgcccattcgcactggcagtgagaggcacacccctgaacctttggggttgttcactgaggacaaacgcggcagcatttagaaagtattcctcgtcccggcagtagacaaaagccacaggatttatggaaagaggaaggaaggcacagaactggggcaaggttctggttttgttctgttattttgttgtcattgttactgtttgtttttctttttttgagacagagtctcgcacttgtcccccaggcaggagtgcaatggcgcactcctggctcactgcaacctccacctcccagcttcaagcgattctcctgcctcagcctctcgagtagctgggactacaggcgcctgccaccacatctggctaatttttgtatttttagtagagatggggtttcaccatgttggccaggctggtcttgaactcctaaccttaggtgatccgcccgcctcggtctccaaaactgttgagattacaggtgtgaaccactgcgcccagccttgtactgtgtttttaaagcaggtttgttcatgcttgttagctgcaagaaaggaaactggaaggagttgagggagggagaaaagcgaatagagggacaccctggagtggaagcctccctactgcccaggcagctgctctgcagccctctctggtcctggccttccccgcagagggccctccccagctcagccctctacgtccggctgcagtaccaggctcttggtacagtctcccacacctggctgtgggccagccttggggacgtgaggcatgctgggccccgtgtaccaagggcattcacctgaccacaccaggtggctccagaggtgtgcctctgcttttgtgtcagtatctttcaatccagtcccttccgagaaaaagagagcttatctcaggaacgtatctgttgatctcaccaggaattgccccactgtgtcccatctgagctctcaggggccagaacctgctgtctccagtgtgtccagatggccactctgtggccactgtccctccagccacttgccctcagcagtcagcaggacacagtctggagactacactgcccatttgctcttgctctttccttgtggcaacaaattaggtccaagaaaacaggtggagctgaaagagggaatgtacgtgccccatgggctcttctccagagggcagggcccaggctccctccctctgtcttgacggctcatggctgcatcttcctgttacggtgggcatgcctcacggactcaggctaccaggtcaagcaggattctgtgctgggtgcattctggacacagtgctcagcacgggggcccagggggtggcatggcccatgccacaatcctcccttggcagatgtaagcaggcagtgtctttctcactaggggcttgtcctttgactagagaggcactgttgcctccctgttccctgctccaatcccagacctgacatgagaccaaggactgggaggtttctttctcgcctctctggctgcctccccagagcctagagcctgtctttggatgagtctttgcaggggctgcttctcatcccaggtgctggacttggactgcccaccactgacacctgggcacagggcctggcttcctgctctcgtgctcttggaaatgaatgggtgcccttcatttgtttttcttcccactagaaatctccctgcctcccatcctctgggctctgctggctgccagctgccagggtgagacccgtgttccactgcaccctggggagtgcctccaggggacacactgagtgccggagccaggagcaaggaacggttcccagtatgtgggggcgggggtggggatcgcgcagtgccgccagccttgcctgagggttcctctgtgagatggagctccctggaccagcctttttgccctcccacctcctctctggcccactcggtgtccacctgccttcagctccaggctgctgtgtgggtccctttcccagaaatgcagttcaggccattgttgctggggtggtggtgttgctggggtgttgatgtttagcgtgcctgagctcccttcatcactaggatgaccttgagcaagtcacttccctctgagctccctgttcccaacctgtgacacacaggtgacaggtggtgtgcactcagaaactccttccctaggatgtgtgacattcttgtcctggggcctttgctagctgtgacacaccggcgcccgacctctctggctgcctccctaatgccagttgtgtcttcagatgagtctttggggggctgcttctcatcccaggtgctggacttggactgtccaccactgacacctgggcacagggcctggctttctgctcttgtgctcttggaaatgaaagggtgcccctcgtttgtttttcttcccactagaaatctccctgtctcccatcctgtaggctctgctggccaccagctgccctgacctggggcagctgaagaactgagatagacctaagttctgggtgggtgcttggaggccccacgggcgtggctggtgagattgccgcttcagggccaaagtgggtgccgggcttcctgaggttcgagagcagatgagaactcttgagtggcaatgagggctgtgtggtggccttctctgcttggcagcctctgcccagcctgcagctgccttgctcctcagagaagcgctgagctttaggccacagaaaagagctgaccatcttctagaagggacagctgctcaggcacaggcgcctctctggaagaggcagtcaggtagaggcaaggggaggggccctgaccttcaagcaggaagagaggtgagcttgtgagacagctttctggggtgcaggtagagagtagcagcaagtcaagcatgggtcagaaaaggcagagttgggctgagcatggggcccagagtctttgcttcccactcctcggtgccgtctgtggttctctgtatggaattttctggccttgggattttgttgacacctggataagtctagaacatgtgttccggtgtctgggacatgcccttactcctcttcagctagggctctgtgcaccccagcaccgtgaatgcacaggactttggtgggagaaatctctgtacttgttcaactcagcatttagcaaatgaagtcacatcagtccccgtttctgaccttgctaacctttgcgagaatcaccgcgagccattttgctccattaggtagagtgatgaggcccggcaggccgaggctggggctcctgcactctgtccctcctctcccaggcagaggtgtcttgaccacaaagcagtgggaacagtccattccatcggttgatgtcccactgggccagtggctttggatagggacctctgacccagctgtgctggaagtaccctgttgtggtcacgctctgtgccttagccccccaccccctggtctcccagcacacgtggttcaggaacggcctgcacccagcatcccttgcagcactgtcaggcacagcccatggaacaggcaggacagaaagagcatttcgctccaggagcttggtccacgtggtgctgaaagggcagtgccaccctgccctctgctgcctggtggggtggtgaggagggcagcattctgtttgtgggctctgggcctggtccccaatttaaggagcttagaaagcagctgtcctatcccagtactcacagcactgtggtggaagtgcttggggggtggtgtgagccgtggcccgagacaggcgttcatggccagagtgccccaggagaagcactgagttggtctacagaaatggatggtccaggggcctggctcctaggcagactgtgaggggatgcttggcatgcagggggttgactagggtgtgggaaatgtagcagggccttcagggttcccccagtgtgacaaggcatccctctttgctgagagtccctctaggggaggccagacgcccagggctggcaggcagctgttctccccatcaaagcagccatctgtgctccaccccaggaaggtgtgggtgttttacatatgcttatccctgatgcctgggtggtgtggtttcatccctagagtttacggatgaagacagtggtgtccctggtgcagacactggggtgattgatcttatttgtgtcgtggccagcaaggcctggggagcagagcaacagccttgctttgcatacacacagggcctcagaggactcaggtgcacacctgcatggcagaaccaggctctgggcccaggtgtctgacactgagtagctcgcctctcccaggggcgctggtgtgggccgatgcaagtgccaccatgggtgtgtgtgtggctccctgggccacctcactccaattaagcaggtccaggtgggacagcctgggaccagccctgcagcagcatgtgttaaccacaacagatggctgtagccaccaggcttgtccttggtgcagtcagcctgggggctgcgggggcttgtggaagcatgtgggaagacggtcccactggtcagcagagcagggtcctcaccgacccacagaggagcatgtcacaggacaggcaggcgtgtcagggaaggccaggctagtgccagccaagggcattgcctcccagactgcccttttcctcacactcccacgacacagccctcaaagcctgtgcccctgtgggtccctggccaaggagcaagggctgccctgcctgggccccccccgccagccccttggtcacctcatgctgtgtgccaggctgggggagtgtgcctgtgtgtatgtccaggtggcatttggatgaagacacaggtgtgtggtgaggctgtgcgggaggatgggcctatgcgtgcggtgggcaggtggtgtggaggcaggcgggcgggcgtgtggcagcgcgccggctgagcccctccacttccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcaggtaggcctggcctggggtgcccctccccacctggccctcgaggctggccctgcctggaccccggctcacatgtttctctcacttggctgcagctctggccctgccccatctcccagtagcttcctgcccagcccctcaccgcagccctcccagagcccagtgacggcgcggaccccacagaacttcagtgtcccctcacctggacctttaaacacacctggtaagttgggcctgaggtgctaaggtcactcctcacctttatgaggcctcagctcatactgggtgtgcgagctctggggccctcagagctcaagttccccacccgagggtcgagggctgtggcctcacccgcctgtgtcctgcagtgaaccccagctctgtcatgagcccagctggctccagccaggctgaggagcagcagtacctggacaagctgaagcagctgtcgaagtacatcgagcccctgcgccgcatgatcaacaagatcgacaagaacgaaggtaggctgcagccagggcaggggcctgcaccctggggacaccaccaggcttgtgtcttagtgtgtaccctcttctgtcccagacagaaaaaaggacctgagtaagatgaagagccttctggacattctgacagacccctcgaagcggtgagctttgcccacagcccacggagggtccacaagggcacagatagcccagccatggatgggcacttggtgatgatgtgggtttaacaaaggcaccaggcagctctttggaccctggccagaggcctccaaggctccactctggtgtgtgctggggcttcaagcccaggcttcatcttggcccatgcccagcctttgccctattcctggctgctgctgtggccctcatgctgggccatcacagccagacctcatccagtcagcagccaggggcccagcttgcagtggcctgaccatcagctggcccagatgggcctgagcctgacctggagttctgcccctgacttgctggtgaccatgggcaggcgactgcatctcagttaccccatttgtagcccacgtgtgttgtcatgaaaatgaaacaaggtggcgctggtgagaagcaggtggaaggcagggctgctggccacaggctgctgtgaggatcagagctcgggcagtacctccaaactgcatgggcattggcatatacctccctttcacctcaactcaggctatcccccaacccctgtctagaagggtctctctgttctgcttgtctggatagaatgccagtcactattgggtggtcctccaggtcttcatgggttgatcctttgttagggttatagggatgagtggggcagggactggcctacatgacaatgaggcattcacagcctgatcaggggcctggccactgtcccttctcttgacccatcacctcactctgccaaccagggacaagcagctcctggggttgagggctgcctgccttcaactctgggtctgggaacagctggtcaactggtaggagctcctgcagaggtttctgatggctgaggcccagtggcagtagttgggatcctgagcctgagaactgccatgtcttccactctttcagcccaagtcctctctctctgcaggtgtcccctgaagaccttgcaaaagtgtgagatcgccctggagaaactcaagaatgacatggcggtggtgagtgggatgccagacacccctaggggaaccagggctctcctaagagctcctgggagtgctgctgagagggccttcaaggtcagggcatctgggcgggggccgggcctgaccttggaccctgcccacgaggcttcctggccaggtctgctgtgctgggtgggaacatgggagaagtcaccctctgtctacggcccccgtgggtgcctccttcacccatttcagaggaggcagggactgtagggaggataggctgtgggggtgggggattattcccaggatcagccaacattgtctgcacaagggtggaggctgtgagagaggcctcgggaatctgactgtgagtgaccatgggcctggggtgtgaaggccccctaaatggggaaccctcgggtcccgggctgctgaccgtgcccatcctgtctccagcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccagggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacggtaggtagacccagaggagctgtctggggacccagggcaagcaggggtcattgtggaaaaccaggcttccactgcagcagggacagcctctgtgtgctcctgcccctccccagctcaggcccctccctcccctcttctggctcctcctgcacagacagcagcgggttttccagtggtcgcctgagagaaaagggtctctgctcccactgtgtcccttcgccccttcaacttgtgtcacgtcagctgtccagggtggttgtgttcagtgggtgaggggtgagtaagcccatggctcagggacagtccccgctcttcccagaggccactagcttcccagaggccactaccttggcagggctgccaggttccactggtagcttgggcacacagggcccaatctgggtgctgtggctccagagagaaccacggtggcagggggcagtctctgagcccagagctggcacacagcagagctggcacacagcagagctggcacacagtagagccaggctgggtccccaaggttgttagaggcagagccctagatcctgttcagatttggttctcactgacgatgaggctctgggaggagagcccaaaggccgggcagcgtgcaggacacatcacctcctggtgcttcggcccgcgcctggggctaccccttcccagagcactgccgggtgtgccaggagcgagcgcagcgccggccgccttaggttcacgcccactgctctgttgcagacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttcatcactgtgtccccttctccatgaatctgggctcgctgtcctgtcaggatgctgtcagccttggggctgcctggggcctctgcctcccttccaggagggacttgaggtgctgcagctgaaaggcaggggcaggggtgtggtggggcctgcggtggcaccaggctgcccagggccatccccaccacccagggcctcacctcttgggcctgcagaaggttggtattccacagctggtggatgaccacttacactgctgaagtgtggtgggctttcgcaggtgtggggacaggatcatcggggagtgccatcatctgcctgtccctgtgctggctgcccacccaacagaaagccctggcgttagaggcctctgcttccctgtctctgaaagtcattacagtagccagaaatgacctgcccaggtgggtctgagcatccaggcagcatacttcccccaggcagtgcccaggccagtgtggggaacagggcctggctcccttctcccactgaccagagtgctctgggtgccagatgggggtctcggactggggtctgtcccttcctcccctctgaaggtgccctgagggtcagatgtgcttcagtgggtgaccagctagctgccaggctgcccttagtcaggaccctatacccagtggggcttcttgcttcagggctggtctcaggggacgtgcagagatgcaggagcctgtcctgctggttgcaccgctcaaaatgtgcactctgcaatgtctcagggcagcccggcaactcggggagtaccagagcctggtcctgctctcctagtcccctccaaaggcaggctgtggccaggggcagcaggcactgaccagctccattctaatcaggcccaggaacacaactcacttttcttggtaaaaagattactttgttttcttttctctgagaaagtggtttaggggctgttgctgccccctcttgtgggctcaggtcagcacaggtaatctgcaggactccaggggaggggaggaagacagcgcccacccaatggacagagtgtggacagagcgtggccattgtctgctttcatgagccctggagacaggatcctagagcaagggacacagcagtttgctgactgcagtgtgggagcctagtaaatgtggtcctggggcccttagggtgcaggcaaaccttacttggactgcccttgcaccccaggaactttgtccagcttgctgttgtgaagcagtggctcctcctcaaggtctgccttctggggtaccttagagtaccccagtgctttagagtcttgtttcttgaaggaaccggctggggcctgtcctttccttgagagttggctgcaggtcagacccgacagggccagtcactgcaggcaccaacagccgctgcccaagtctttcaggatcagctgtgtgtgcccaagaagcccctgcctcagttgcctcctctgtaaagggaagcctgccttggagggttctaggaggaataaatgaggttctgaggatgaagcccatgggtggtgcctgtgaacattctagaacagtcaatatagtggaagctggctctgttttgggtaaaataaaactgcatgcgaggcctgggactaagcctgcatgggtttcctctgcaaggacaacgcccatggcacgcctgggctcatcacaggaacaataggggccagggttggggccaaggaagatgcctggtctcgagccactccccgctcactctgcagaagatgccatgagcccagggctccgtgggcagtgccatccctcctgtatcctgtctgcttgtggagggggacgtgggccaagcagggcctctgccaggcagccagtgtacgtccttccccctagaaggccacccaaggaggccccttctgaccgcttgctgtgctggcttggggtgcctgccatgaggccttgctgccctgcgttgacagcccctgtgactggcccccagtcctgcccaccccaccctaggcccctcctggtggtttcagcttacagggctcccttcagctgcccgttcacccccaaatccttgaggttggcccagcagaggactttcagctccctggtcagcacctctagtgaccacccaggctggggtccctgtggggcacttgcccctgtgagcacatggaggacaccagcctgctcacctgacaccatttaattcgaggtggagttgacaggctggaagttgccacccgcacacctgcctgagggagaagccctccgtctgcctgcaggcctgtgtcctccctgctctacccacactccactgaggcagccccagacccaccgcgcgcccaagggagcagaggccccggaaaggttgtttcctgaggggccatccagaaagcgggagggcttgggacccatggagcagcaggtccggagggagagcatggcctcttcccgtgtcctgtcagggtccccagcactgcagggccacactttgcccagaacagctcactggagttgccaccgcagctagggaagggccttcactcaatcccattctctgtgtctccctagaagggagagccctggacaatgccccagctgggatgttcccaggctggtcccattcaccagtcagatgtcctcctgatgtcagccccggccccaaaggtaatagagtgagctcaagaactcaaccagaatcctgggctgggtgggggccaccattgggatggggaagtgccttggacaagtggcagggaagcaggactctggttactccccccacccccatccccacagttgttgctgagatggcaggaaggaatccctggatggggtgtgcccggagcccttctcccagcgtatcaggaatcagagccacaaggctggagatcctaggcccagccacagcagcaatctgaggcaaagacccagcagggtaggggctgtcccagagtcccctcccatttcaggagctctgcttggaggagggaaggtctgggaagcaccctgtgcccaccatcaccactgcactgaccacagcccttgggcttcctgagagcagcacgtgctgtgcttggctgtataacatcgtccagccatggctaggggcagcagcatctgtccaggtccctcagaacctgtcctcactgggttggcatacagaggccagtgcagccaggtgggcaaggacagtctggaggggctccccggggtggcaggagcttcccatcaggcacgaaagggcccaagtctcacctttctcctgtgactcattcattatgagcttgtaatggggatctgaaatcaagcgcatgctcttctcatcacttgtgaagccacagccattctaagagaagcagcttgggctgtccactaccccctgctgaaccccgagagtcctggctcgccactggctgactgggccctgccccacaggtcccgctttccaccacacctttgctgtgggcatgtgagggcaggaatgaccctgcctgttccctaggcagagcccacccagcacatcagcctcatcctcccatctgactacaagacgcccatggtgccaggcaggacctgggccccaggggtacaggggtgaactctgggagcccctggccatggatgagcatggtcagtgtcatgatcctgtgggcatcagggactggggagaggctcaagaagacatggggaagggggatcctgacataacagatgcctggtgatggaatacttagcacctaggtaaggcagcaccagggagcggggagggagatgaggctgcaggcactggtgccctcgctggagcctctgctgaagcagggagggaggagcggagccacatcctggcgggccctctttctgctctggtgggcagtgggggtgaggagctgctaagggtgcagttaggaaggcccagcccgaggacagtgtgggcacaggcgaagccgggggcatgcctgctcctgatccggcatgtttagttggagaaaattcactcagttgtgcaccggcactgggcatgttttccttctacgaagtttttaacagatgtgtacctgaccctgcctggagaggggagggctggcagggtcagcgtttgaaatgatgctgcccccggcgggacaggcagacaaggagggcaccgccccgggcctaggcgggtctccgtcctggggcaggggaagagctcagcatggcaggacctagcgtgggcttgctgccctgtgtcctccctgagcccaggcaggtgctggagttcatgtgctgcgtttctgctctgcgggccgccgccgtgttcaggcgcttggggaggcagggcaggcctagggccctgtggctgggctcacccttgttctcccacttcagatgctcgatcttctagtggagcttggccagcaactccaaggactgctgctgtaggaactgcaggcccaggtccaagtccaggatctgcctctgctggtcgatctggacacccacagaccggcggcactgcggggggtgcgacgtaacctgagatcccggggaccagctgggaggctagctcgcacggctcatgtcgccacccccaactacacagccgctgccactgcaccctggctcagtggccatgctgcccgtcacaatggaaaggggcgtggctgaggagcagggtgggcagctggggcagggcctgtggctggctcttcctgggtgagtacagtctgatttaaaaggcacccagggctgggcacggtggctcatgcctataatcccagcactttgggaggcccaggtgggcggattacttgaggtcaggagtttgagaccagcctggctaacatggtgaaaccccttctctactaaaaatacaaaaattagctgaacgtggtggcacgtgcctgtagtccaagctacttgggaggctgaggccggagaatggcttgaacccgggaggcggaggttgcagtgagcagagatcgcgccactgcactccagcctgggtgacagagggagactctgtctcaaaaaagaaaaaataaaataataaaacgcattcaggcattctctacagcctgggcaacatagtgagaccctgtctctataaaaagtaaaagaaaaaaaattagccgggcttggtgctgtgctcctgtagtcccagctacttgggaggctgaggcaggaggactgctggaatcccggaggtcaaggccgcagtgagctatgatggcaccactgaactccaggctaggtgacacagtgagatgctgcctaaaagaaaaaaaaaaaaagaaatatgtctttctttacaaggcctgccctaaaaaaaaaaaaaaaaaaaaatgttcgccagagccaggccaactgtgattttaccagatgccaacatacccaacccaagggaggaagggaacatacccaatcccagcctgttctagctcctcttccccacatcttcctgccacatcaatagggctcctgtataataacaggggatacaagtgaaagaacagcccatctcagaacttatttgagaaatgtctaggaaaccctaaagacaacagggagacaaaaactaagacaccagaggaagtttatgcctctgacacttacagttagaacaaacagcacacatggcccaacccctaaccagagcaaaataaaacctcacacaggccgggcgctgtggctcacccctgtaatcccagcactttgggaggccgaggcgggtggatcacgaggtcaggagttcaagaccaccctggccaagatggtgaaaccccatctactaaaaatacaaaaattagcgggcgtggtggcaggcacctgtaatcccagctacttgggagggtgaggcagagaattgcttgaagccaggaggtagagcttgcagtgagcggagattgcggcaccgcactccagcctgggtgacaaagtgagactctgtctcaaaaaacaaaaacaaacaaacaaaaacttcacacagaaagcccatttatcacgtaccccgtacagcatgtccagctccccacaaaaaatttcaaggcataataaaaaccaaaaaatgcagtttgaagagacagcaagcatcagagccagactcaaatatggcagagatgtcggaattatcagaccaagaaatggaatacaactatgattaatatgctaagggctctaatggaaaagtggacaacatgagattacagacagaaaatggaaacagggatagacactctgagaaagaatctaaagaatatgtgaaggccgggcacagtggcttatgcctgtaatcccagcactttgggaggctgaggcagcggatcacttgaagtcaggagttcgaagaccagcccagttcgagaccagatggcaaaaccccatctctactaaaaaatacaaaaattagccaggtgtggtggcatgaacctgtaattccagctattcaggaggctgaggtgggaggactgcttggacccaggaggtggaggttgcagtgagctgagattgtgccactgccctcaaatctgggtgacagagtgagacaccaccaaaaaaaagaaaagaaaagaaaggaaacaaggagaggaaagaaaggaaagaaagaaagaaagaaaagaaagaaagaaagagaaagagaaaataaagaaaaagaaagaaagaaggagaatatgtgagaagtcagccaggtagtgactcatgactgtaatcccaacactttgggaggctgaggtgggtggatcacttgaggtcagcagttcaagaccagcctgggcaacatggtgataacccatctctactaaaaataaaaaaattagctggatgtggtgtcatgcacctgtaatcccagctactcaggaggctgaggcaggagaattgcttgaacctgggaggtggaggttgcagtaagctgagattatgccactgcactccagcctgggcagtaagactccgtctcaaaaaacaaaaagaaaatataagaagtcaaaaacacaacagaatgaaagatcagggctggcagcagtggctcatgcctataatcccagcactttgggaggccaagttgggtggatcacctgaggttaggagttggagaccagcctggccaacatggagaaaccccgtctctactcaaaatacaaaaattagctgggtgtggtggcgcatgcctgtaatcccaactacacagaaggatgaggcaggagaattgcttgaacctgggaggtggaggatgtagtgagccgagatcatgccactgcactccagcctgggtgacagaaggagactctgtctcaaaaaagaaagaaagaaaggtcaggtgcatggctcatgcctgtaatcccagcactttgagaggccaaagtagaaggatcgtttgagcccaggagttggagaccagcctgggcaatatagccagaccctgtctctacaaaaaattaaaaaaattgccagcatggtggtgcacatctgcagtccctgctactcaggaggccaaggctgcagtgagctgtgattgtactactgcactctggcctgggtaacagagagagaccctgtctcaaaaatggggtaaaatggtataggaaatttggatctaaaaaaaaaaaaaaggaagtgcattagataagaaataaatgaagataaaatagaatcttttttttggtgggggtggggaacggagtttcactcttgttgcccaggctggagtgcaatggcacgatcttggctcaccacaacatccgcctactgggttcaggcgattctcctgcctcagcctcctgagtagctgggattacaggcatgtgccaccacgtccagctaattttgtatttttattagagtcgggggttactccacgttggtcaggctggtcttgaactcctaacctcaggcgatctgcctgcctcggcctcccaaagtgctggaattacaggcatgagccactgcacctggccagaatcttgtattgttcttatttttagttgaacagatggcaggttattcaaaataattatatcaacatgtattcagtaattatagcttatggatagctggaatgaatggcagcaatgttataagggatgggaaggaggatatcctgagtggaaagaaagtcacccaggctggagtgaagtggcacaattatagcccacttgcagcctgcaactcctgggctcaagccatccttctgcttcagcctccctggtaactgggattacagacacacaccaccatgcctggctaatttttaaattttttgtctcgctgtgttgcccaggctggtctcaaactcctgggctcaagaaatcctcctgccttagcctcccaaagtgttgagattacaggcgtgagccactgtgcctggtttatggttgcttttgaatgtcctagtcctacataagtggcttccaagaagggaaaaagaaaaatgcaggcaggaaaaggtgctgatccataaaaacctctggaaggtatgtctctagggagggggtgagtgttgaggagggatgttgcaaacatggtagtggagatggcaagagtggctgcctgcctcttcgtctgcacttccacaatctgaagcagccatcatcaatcggaacacagatccccagtatttggaggatggggctcttattgcctgctgtggctcctgcaagctatagggaagctaccccagaagtataggcatggctgcttgcaccaccaatttaaatgctaattacttctgaaaacaccctcacacacatgcccagaaataatgtgtaaccagatatgtgtgcatccagtggcccagacaagttgacatatagaattaaccatcacaagtccaccccttgtcaacctggtacctacacacatctccttaaaccatacttaacctccaaataaacacaataacaaagtcagtgttagcagtggaaggtgtctgagttagtggcagcgaatccgtatgggtctgcagcaacctcaattcttgcctcctcagaaaaaagaattcaactggccgggcatggtggctcacgcctgtaatcccagcactttgggaggccaaggcgggcagaccacgaggtcaggagatcgagaccatcctggctaacacggtgaaacctcgtctttactaaaaatacaaaaattagccgggcatggtggtgggtgcctgttgtcccagctacatgagagactgaggcaggagaatggcaggaacccaggaggcggagcttgcagtgagccgagatcgcgccactgcactccagcctgggcgacagagcaagactccgtctcaaaaaaaaaaagaattcaactgaggggcataaggcagaaaaagagaccgaggcaagttttggaggaggagtgaaagtttatttaaaaaagctttacaacaggaaagaaagtattcttggaagagacctaaacaggcacataaaggtcaagtgcggtgtttaaccttgattctaggactttatagactgacccctttcccaagattcttcccctagggtgggctgcctacatgcacagtgtcctccttacccttgggagatgagcacacgcagtgtgtttaggaaactgtacgcatgcccatctgaagatttcttccgtcccagaaggtcatactctgccattgtctcttaatgcacatggccggggaaattgcttctccctggtgcctgcattcaattaacactttaatgaaacaggtgtgacccatcaggaactggcctctccctgatgccagctgccaatttatcactttcatttttaatttattttttagaaggagtctcactctgtcacccagactggagagcagtggcatgatctcggctcactgtaacctctgcctcccaggttcaagtgattctcctgcctcagcctcccgagtggctgggattagaggcatgcaccaacatgcctggctaatttttgtatttttagtagagatgggctttcaccatgttggccaggctggtctcgaacccctgatgtcaagtgacccacccaccttgacctcacaaagtgctaggattacaggcatgagacaccatgcccagccctggctttttttttttttttttttttttttgagacggagtctcgctctgtggcccaggctgtagtgcagtggcatgatctcgcctcgctgcaagctccgcctcctgggttcacgccattctcctgcctcagcctccagagcagctgggaccacaggcgcccaccaccacgcccagctaattttttgtatttttagtagagacgggatttcactgtgttagccaggatggtctcgatctgacctcatgatccgcccgccttggcctcccaaagtgctgggattacaggcgtgagccactgtgcccagccgctaattttttattttttattgtttgtagagagggggtctccctatgttgcctaggctgttttgtttttttttttaaacagagacagggtcttgctatgttgcccaggctggtcttgaactcctgggctcaagcagtcctcccatcttggttttccaaagtgctaggattacaggcatgaaccaccaggcccggtctccactgtgaatcttttttttttttttttgagactgagtttcactcttgttgcccaggctggagtgcagtggcaccatctcggctcaccgcaacctccgcctcctgggttcaagcaattctgctgcctcagcctcctgagtagctcagattacaggcatgcaccactacgcccagctaattttttgtatttttaatagatacaggttttcaccatgctacccaggatagtcttgatctcctgacctcatgatccacctgcctcagcctcccaaagtgctgggattacagatgtgagccaccgcacccggccgctaatgttttattttttattgtttgtagagacagggtctccccatgttgcctaggctgttttttgttttgttttgttttgtttaacagagacaggatcttgctatgttgccaaggctggtcttgaactcctgggttcaagcagtcctcccatcttggtctcccacccaaaatgctaggataggcgtgaaccgccaggcccggtctccattgtgaatcttttttttttctttttttttttttgagactgtgttttgctcttgttgcccaggcgggagtacagtggtgcgatctcggctcaccgcaacctccgtccgcctcctgggttcaagcgattctcctgcctcagccttcctgagtagctgggattacaggcatgcgccaccatgcctggctaattttgtatttttagtagagatggggtttccccatgttggtcaagctgatcacgaactcccgacctcagatgatccacccgcctcggcctcccaaagtgctgggattacaggcatgagctaccgcgcccggtttaccattttgaatcttaagaggacaaagtctggttctctagaaggcccgagtagcttttcccctgagcatcttgagaaaaaagtgctctgagcactccttgggaagtccgagacagcacatgcagccaggtgctccctggctgctctcccagaggtcagcacagctggaggcagctggagggaggaggctgcagaggcgctgaagccaggaagacccaacagtggagagagaagttgcctggtgactgaccctcggcttgaccctgtgctcccctgggctgagctgggtgtcaaaaggcctccaccctccaaagtgccagcctcctgctgtggctggaaagcatttgctcctcctcctcttctcacttctttgcattcttctgatctcttaagggcgtacaaagattcacatggatattaaagtcaatggtgattttcatagctggaatactcgttgggagaaagtaggaattcttttttttttttttttctcccaagctcaagcgatcctcccacctcagccttctgagtagctgggaccacaggtgtgagcctccatgatggcctggctaattttttatatttttagtagagatggggtttcaccatgttgctcaggctggtctcaaactcctgagctcaggcgatccacctgcctcggcttcccaaagtgctgggattacaggcgtgagccactgtgcctggccaaaagtagaaattcttgattgggaaataattttatatatttcggccccttctcacttgggaaaattctgctaagaattctggttttgagagtcaagggaagctagcttaatttttaaagtgaaggctacataagagtcctctctccagtgtggtggctcacacctataaacccagcgcttcgggcaaatcacttgagcccaggagttcaagaccagcctggcaatgtagtgagacccctatctctacaaaaaaatttaaaaattagcagggtgtggtggtgcgtgcctgtagtcctggctacttgggtgggatgctgatgtgggaggattgcttgagcccaggatttggaggttgcagcgagccatgatggtgcattgcactccagcctgggcaacatggcaagacctcgtctcaaaaaaatacaaagagtcctctctatgttggaaatgtcagagttattggccatttaggggatctaacttgctctttgatgtccaagaggaaaggtatagagttctcctgattacacagggcctctgcttgtgggtcgcctgcatgaggcgatcagaatctgagtcacctgggatcatgtgggtgctggtacatcctagagataggatgtgttggtcatggaagagagtgggccacaaatgggttccaggggaatagcgttgcctggtgcaaggagggggatgtggaggtgcagggagcaggggtggtgtctggagagcctgaagctgtgctgccagaggctccaggccatgaggtctgagaagcatctagatttggcctgttcacagcagggaagtgtggtccagtggcaaaaagttgagggcatcctaggagttgaggaggtggtggcggttagagtaaaccactctggaggcgtccggggtggagagacgagaatgtgcaagaactcctgcctctagcctggcctcctcaggaccccggccaccagcctccctcctagaagtccccagagcttcctcctccttgtgccccagaactggttcctgggttgctccaaccccagaccttccctggaagtcccccccagtgcctcctggctgggaacccccaactgcattttgcttctgctctcgtgccagtagtccccttttctctccagtgtccaggccccaaccaccaagaccctgcctcctcacttggctttgctgttcttagttctctactcagtaggttgtgtctgcctccattcctggccagacgctgccctggggctgagtgcacagtccccagccactcccgagatcctcagagcttctggaagccacagacatggtggcatatgtttcaggtcgtcagcttgtttttttttggagacagagtctcgctctgtcgcccaggctggagtgcggtgacgtgatcattcactgcagccttgaccttctgagcccgggtgatcctcccacctcagcctgtcaagtagctgagaccacatgtgtgagccaccacacctagctttttgaatcttttttttttttttttttgagacggagtctcactctgtcacccaggctggagtgcagtggcacaatcttggcttactgcaacctccagctcccaggttcaagtgattctcctgcctctcccgagtagctgggattacaggtaggtggcaccacacctagctaatttttatgtctttagtagagacaaagtttcaccatgttggccaggctgatcttgaactcctgacctcaggtgatctgcctgtcttgacctcccaaagtgctgggattacaggcgtgggccacgcgcccagccaactttttgaatcttttgtagggatggggtcttgctgtgttgcccaggctgggcttaaactcctggactcaagtgatcctccctgccttggtttctcaaacttctgggattacaggccaatctactcaacgttgatattgagtagaaggcaaaattcacatggctccggcccagcccctttctgtctcaggcacttcagtgttaatatgcgccttggttttgctgctgccgagtctactgtgcccctgggcaaggaaagcaaaggaaaccagagggccaggcccgtggacactggggtgaggggccaacagggtgcccagcagttgtttccacagcccccacgtggtcagggaccctgtatgggtgaaccgcctggatactgagcctaggcggcggaaaactcaaaagcaagggcaggtttattcagatccctggtggagttacaagcttggtttggtttttggtcacaggccctaaaatacctgtattctgagtttacataaaaatacaaagcactggccgggcgcgctggctcacacctgtaagcccagcactttgggaggctgaggtgggtggctaacatgaggtcaggaatttgaaaccagcctgactaacatggtgaaaccccatctctactaaaaatacaaaaattagctgggcatggtggcgcatgcctgtaatcccagctattcgggaggctgaggcaggagaatcacttgaacctgggaggcggaggttgcagtgagccatgatcgcaccgccgcactgcagcctgggctacagagcaagactctgtctcaaaaaaaaaaaaaaaaaaatcaccaccgagacgctgttctccctggtgtgtcatctgtggggtgaatgaaggtgtgagataccccgtggtggtttctgtcagtgaatctgtagttgtcatatattttgaatacttcaatatcatcgaacagttgctgtgtctttaagcactagattttattgaagctaccttcttccctttttagtcccatttcccctagatgcatccacgactgcaggaacccccctgcccccaccaggagcccaaagataaccatgttcccacctggagtggcctcccacctccaatgccatcagggctggtgcagcttccccacctggtcagcaacatcatggccaaggagtagagggcgtagcccagggtgaacagcagtgcacaggtgaggggcctgatgcagaacagagaggccatgaagaaagccagcagtagccagggcagtgtcaggtagctgcctaggaagtgcaggttgagcctgtggccgctggccagcgtgggctctgtgaggtggtagcaacagaagctggcaaggaagtcatctcaggaacacagagccgccatctggtctgcaaactgaagcgcaggcagtggcacgggggcatggggtggtggcaccacaggcctcaggacagctgcaccccacccccacaggccaccctgagactgcaccccaggcaggagcacccagaaccctctctgaagaggccaggccagccctcctgcccactcactctgtgtttgatggcagatgacagccggaaggatgctcagaccaagctggtaatctcataactccagaggggctgcagctccgggtccccctggtactcaatttcaaacctttgcagcctgttgatgatctagaaacccaggctatagggttgggccagaaaacatggccctggccaggtgcagtggctcatgcctgtaatcccagcactccgggaggccgaggcgggcggatcacaaggtcgggagttagagaccagcctgatcgatatgatgaaaccccgtctctattaaaaatacaaaaattggccaggtgcagtggctcacacctgtaatcccagcactctgggaggctgaggcaggtggatcacgaggtcgggagatcaggaccatcctggctaacactgcgaaaccccgtctctactaaaaaaaatacaaaaaaaaattagctgggcttggtggcgggcacctgtagttccagctactcaggaggctgaggcaggagaatagcgtgaacccaggaggtggagcttgcagtgagccgagattgcgccactgcactccagcctgggctacagagcaagactccgtctcaaaaaaaaaaaaaagttagccaggcatggtggcatgtgcctgtaatcccagctattcaggaggctgaggtgggagaatcgcttgaacccaggaggtggaagtttcagtgagccaagatcatgccactgcactccagcctgggcaagagagggaaaccttgtttcaaaaaaaagaaagaagagaaaaggaaacatggcccctgcacacaactcagaagagccaagccatctctgctcacaggggaggagggagctggggacacgtcagggcccaacccatgcacctctgggacttgggcctctcacctggtactggcccaggggcgtggggatgagtctgtcctcacccgcgatgcagtccggagctgcttctttccattctcatcctggatggtgtccaaggcaagtgtgagagactctgcgtgagctgcacttcactgagctaccagagagagagaagctcctctgccctcagtgtcaaggcaaaggaacaccagtcttcaccccaccagcctctaacagtggcaacgagagcacccggacatgacactcggggtgtgggcctgcctcccacaacaccgggttcatctgcatggggcctgggacggatgcatgctgaccatgggcaaagggggagtggatccttcggggaaggggaccctaacggccgtggaacaggccccattgctcatactcggaatatctggcgcaggtacgccagggcctcctccaggcactcgtccatcttctggacgctgtcctgccccatctcgcccaggtcatggctgaataggagccgttggtgtctgtggggccaaagcccagccacaacaggaaggagtggccagctggagtctccacacactggtccgagatggacctggccgtgtgcttggcctgcgtgatgagctgagtaaggtgcaggacctgcaagggaggcgagggcaggtcaccggcaggatacgcctgtactgccacccaggcaggctggctgggggccctaagatgggtgcacagccagatcactgagtgacgggaggagcagcttctgctggaggacttttaaagactaaagaatgatcttctaaatgtgaaatttcccaacactgccttcgttatcagaaacaaatcagactttactgaaacggggaaaggagatgtgcgtcaactctccgcccaacctccctccctcccgccagaacacagcacttccctgcctctgctcagccttgtggctccaggggtcctgtgaaggggcaccgccaacccactcaccagggtgtaagcctcgggcccgaacatcgggtgtacttgcagtcctggccctccaggccatagatgtgactcttcacattgaaggaggcatcagtgaccactggtggccactatgacaggatgctgctggcgaatgtgcaggctgtgaagagtcggtgctggcggtagggggatgacgagctccggctccgggaacagctgctcgaactggaaggcaggagacgaacctagcgcccacttccgggggcacagagaacctggttgctgcccacaggttttcaggatgcctccgaggtatctggggagccatgacccaggggtgtcctcctgaggtcctgcccagcagtgtctcccatgtagcaggtggccgacatggggagggcaaatgagggagctggtggctcacagagcccccgacagtgtctgcaggagggcaaacaccaggaggagtgacagaagccaatgtccaacccagccaagacaaacgcatgccagagaccaagaccgcctcccaaggatgctgccacgagttgccagggagaaactgtggtgccatgggcccgcagcttggtctgtgcagaccccctctgtgggtatacctgcggtcttccacccagtgcctggtgcctggtggctgcagggcaggcagggtccagccggtctcagccttaactgtgcagtgttatggatgacagctcaggagactgttggcaggcagggagggcaggacacaggcaggtgagacccaggccctctgaggttgctgcatccttagcaggcctgaggcccctttccaagaggactgaagccaccatggcagaggccagcccagagcctgagggggctgagggaggatcccccagagggtccaaaggggaaggcctcgggcaaggaaaggagaggtcagtggccacgccaggtgccatggaagcctgggggggtctgctgtgaggatcaagcaggagatgaggggaaggtggccactggtctgctctgtgctggtaaggaagggttaaggaacagtttgggggtcaccatgaaaatttgtctgggccagaagggagaggggacaggtcacccactgcttccatgagaaacccattctagggcctggcgaagttgagcctaggaagggctggtctgtgctccactcagcagcagctgggagagggccagggccaggctgaccccagcacaggccgctgtcttggcctccacccactggagcaacatttgcccaggggagccagtggcatgtgaggagagggggccagggctcaccatttctcagacacactggggctgggagttgctgctggcagcctgcttgtcagctgcataccaccatggctgcaggtagctcagccacacctccaggacctgtgggggaggtgtgtgctgaaggcccagtggctggggccaaatcctctgatggcctggaacccaggtacccaggtggcagctaagttggctcttcccacgtcccccagagggcgcaggagagacgcgcacagccctgtgagatttggttctctcactgctcttcagaagccagggtcatgggcgggctcttcccggcccacgggacccagtgctacctggttgcgtaagagtagaaacctgtctggcaccagacaggtgggatggggcagggctttgctgtgcctgagggttgcctttggaaactgaaacagaaagaacaacgtggccctccaaggccccctcctctccaaggtctctgtgacaacacttgttctccttcatccaccccaggggacctccctcattggggcacacagaagacacaggcacacatgtgatggggccgacactcctagctctgaacaatgcgtccaagggccagtggccaaagcaatgccgcaggaagaggtagagtttctgctggactaacctcgggacagcggcctgcagaggaggggagggtcaccagccgcttgcacagtaaggtggccctgctcacagatgagcccggggttcccattagtgagggttggctctgctgggagagagcactaggcacttctgagtggtaagagctggtttcagccccattcttcagaggaagaaaccgaggttagggagcatcccgaggacacagcatgcaggcggccaagccattgcatctcctgcacacacctcacctcagccccacacaaaacagcccactctgccagccccgatgggcctgggagtcaggacccgccccaacccttctcctgacgggtggggaggagcaagagacggcaccgtgatggggcctttttggccagtctggagagagaggctctgggagccagagatcagccggcagccccaccaggctagctgagaaggcacttgcgtagccctccagaggcctcacgtgctctgtgagcaggaagggattcccctcaccctgccccccatgccccggggagaggtcgccgtgggcaacaccggaggaggggaacgaggaggagacagcagcggctggaagccgcaagggccacccactgtttgaactcccccagcgggctggtggtgtgggagtggacgaaaggtgagacctgctctggcttcaggctgtcggcaaaggcgtgcaggtgcttcagtggcaggcgcaccaccagcatgtgccccttggtgggcatgaacgactcctaggtggaggaagaggagtcagggcctgggaagggctgcagcacgtggcctccaggtctgaccacagcccgccctgggacagctgatctgcctccacacaggaggcacgagccaggcaaagagtggggccaccactgtgcctcacacccagcgggtgtgccttgcactgcttggtctgaactgcgaccagctcgtggtagggaagtgcttggcccagcgcccacacagcctacctggggagaactcgctgagacagacgcatctgcttctgcaccgctgcacacccgcggtgggtggcacagggctatggcccgccagactgtgcccttggccattgctgcctatcttgatcctcatggcaggaggaggccgatgtcacccccaagctctggatccagggtctcccagggaagatggctaaggccaggaattcgagattcgcttgggcaacatagggaggccctgtctctacaaaaattttaaaaagttagctgggcatggtggtgtgcacctgtagtcctagtgactcaggaggctagggtgggaagatcgcttgagcccaggtgttcttggtgcagtgagctaggatcgtgccactgcactccagcctgggtgacagagtaagaccctgttcaaaaaataagaaccttcacttttctccccaattccttccatctgctcctcattctggacacagctggatgagggctcaccctgggagaagcgctgggcatcaattcctctgttgcccacagacctgtggtcaggaaaaccccaagacaagagcacagtcaagctaacaggccaagcttttgatttacaatgtacaagcaggatcctggagacctacacccaagaggaaagcctttttgctggctgtgggctttctctggttgctcagcattgagagggcaggggggagcatcaagagtggatgagggcaggagaagggggcactgagggtgggcccctgagtccgagtggacatgctcgcctctccatgcttacccccagccctttgggcctcaacacatctgtgatgctgagactggtgcagggcccggcctctgggtatatcctgggatgctgcagaacccacatggaccactgctcacatcactgcccactcaagtctgcccgtcaggaaaatgtccccacaggtccaggagacacaccccacagatcagtggctgaggctgggaatggaggtattttcttcttcttctttttctttttttttttttttttgagacagggtctcactctgtcacccaggctggagtgcagcagcacaatgtcggttcactgtaacctctgcctcctgggctcaagggatcctcccaccaaagcctcccgagtagcggagaccagaggcacataccaacatacccagataatttttctatttttttgtagaggcaggggtctcatcatgtttcccaggctggtctcaaactcctgagctcaagcaatctgccttccttggcctcccaaagttctgggattccaagtttgagccaccgtacctggctattttcttctatctctatctttaagtatttaggcaatgaatttgcattgctttggaaggaaggagaaaaccagtacctatacggcccgactagaatggtactagtggggtgggaagttagaccagggtccttctcctccagtctcacccctggccctccctctgatcctggcctgggatcctgagccatgacatcctccctgcagctcacgggaggggacagcatccacataggaactgggaacctgccttcccctgcaggttcacttacccaacatcacctggtccttccagagggtctggaggggccagtgtctgcccctgcccccagcagtcacatgaaagcctctcaggctattttcccacagatttgctgagccaaacttttccctcagctctgtacccctcctgggccacattcccatgtgtagtccctggccacagtcacacctgcttgcttctcaaagatgtgtacccaaagccccgcatttcccactgggcccagcctcacagcacctcagctcactcctccagggtctccctggtcacctgtcctgccatgggggttgctagatgcttcctggacactgccctggcccaagccctcatgtccctcttctccagtggctcctgcggaacagggacgccatcacatgcagtggttgccatcccaacccaccggcacttggggcccacatgtttttttcatcttgcgctcaaattcccattcaatcacgtgtgctccttcgcagggtgaacgggacagacccctggctgtgggcacagctcgtctccccgggctctcacagactcactaactctgtcgtccccgaaatcccccatgggcctgaactctgcttcactgacctcaaatccatccatacgcttgtcatttgtgcctaggcagaccacaacctctatgaggtcactacctattctcatccacctccacaggtgtctacgagtggccagggctccctaggtgaaggactgacagcctctgtgagctatagggccaagccccaggtcctccccaacccccttgcctcacacacagtctgggtcatggaacctccaagctggatgacagttctgaacagggcagcacccacattaccgtaagtcccaggcctctgtgtcttcagctccttccttagcactgggccctgcagagtgggggtgaaccgggccactgcagaggcctcacgactccagctcttcaaaccagggccgagcacagagcctccaacaccagagaacttgtgacacctccaccactggtggggagtctggccagcccaggccacatgcctcattctgacacacagccacaccccactcccacaagccaggctagtctgcaaagccaggggccaggccaggctggaggctgatctctgcctccctcaacacaggggcttcactctgcctgaaactagcctctgagtcacctgcagctgggcccagccagccccttgctttgccaggcgcagacacgcactccgggcaggggaagggaatgaacgagcacagccagtacttggtaggtgtggagggcctggaggttgggctgccgggggctgtggtgggcactggagacacagagtcggtagtgcagcacctccagctgagagagtgaacagagagaagccggaagaggcagaagagaaaagcatgagaggacagggtggtgaaggagagacatggtaccggacatgggagggggaagtggagaaagaaagcaatgagaacgagcccagaagtgaggagaaaaaaacaacaaaagcatggtcagtgaccatccaaacaactgcagtcccagcagctgtgaccagcgcagcaccctcctcggcagccaggccagagctgtgacagcactctcctcagccttggaggctgggggcggatagaccctccaggtcacctgggtggcctctcaatgtcgctggggcctaaaggcctctccagctcattggaagggcccaactcactgcccttccagatgggacccgctctccccagtgactctgaggccacaccgtgtgtgccatgtgcacaccacagcccttcaagtacccagggccttctctctgggacatgctgtcagccaccaaggcctcaagatcctgaggcccagaaaataaactggcaaagcatgttctaggaggaggactctgcctagagaagacacatatgtaattgactggatttccctgggttgttttgagaaatttatcaaatttgtatatgacatgatcaattcctatgtctaaaacccaatcaatgtcccctccatgagtggatctctctgagagctgaggatgaggacaggtccccaagggtagcacaggctcaggcccccaggccctgccctccgcactcccccagcctggaggtcagccgaggtggtgtgtgcatcagctctgactccaggaggcaacctctcctaccgcatcaggaactcccaccctccagatatggagggctcccaagggcaggagcccccgaggacctggccacagccacacacacccagaggcaacaggaaactgaggctaagctggcccccagccaggaccctccaatctaccaccctgcagcgctgcagcctccgaagcaccccttcggcccagcatagccagagctggcctggtgcatatcctgccccgtgagcgccatgcctcctgcccaagtagcacgaccactgggctccacacaggagacatcagaacacacctgctagatgtcacaacacgcagagcagggcgggaaggagcagggcagagagatgttgcccttcacagccttcctctgtgccagacctagggctcaggcaggaaacagacacacagttctccagtgcgtctctgcccttgcctaaggaacacggtggcttgtggggccattggccatctttatggcccacggggccaccagggagcaagcatgcacctcggattcaaccagggtgtggagggcaaccctgggagcctcacttcctgcatctgaaaataagagctagcagagacaggcagggatttctgtatggcaggagcagcataggcctgggcaagcggcaaagggccaggggccttgggggccccgacctccacagctgcctttctctgacccccacccacccagttttctcacgttttgttttttgcctcaactggaagaggcaaaaagtggagcatctctgggcacttcgtcccaccactgcaagtcattctgagcaggactcacgcaacccaaggtctggccaagaggaagcgaacattgagaagaggggaaaggcacctcctgccctctgcagggacgacgccttgccagttcccctgacccatgaggacacagaatcctcacaggtgacagcccagaagagcctttctggcttgcccttgaaagtaggtgtgtttccactcactcagtaggcagaaccagcagataggaaggtgacacagtgcagcggcccctgcccctgccaggtcaagccacatgcaagagcgctgagcaagtgttctagggcgccagggagaagcggggccctaggaaccaaccagccccccaggcaccagccaggcatatgcagtaagtctgctctggaagcgggaagggcactgcaggctctttgtgactcaggaggcccaagatggggtccccaacttttccttgtgctccttccaggtgatgctgagggtgaggatttgggggaacctatgctctgagagagccttcacatggcaaagcatggggccacagaactggctgcagaggctgtggcagaaacagacccacagctcttctccagaaccggaggaaaagtgacaggaggctcttctgaagtttaactccatcacccacagatccttcattctggatgaagccttctggaactttgtcagcaataaaggcaaagtctcccatgcatagacgccacgggcaccggactacaggatgtgtgcccagggcatgctgcctagagagagagtggggagaggcgaggcggagggggaggaagcaggccaggctgcttgtaggagggcgccaggccccacacaccatgagtatggcggcttgctcatgctctggaggaggtgggggagtggggggcagacaaaggaggctaactatggtgccactatggtgggcatgggtctgccctgggccatcacttcatgggaaagcacaaaggcactgctgatggtggaggagacagacgagaacgcggctcccagaggcattgcagctcccccacccccacagcaaaagtgccacaacctcatctgttcctgttgccagggagggggctccggaagctgcacaggaaaggccctggagaggccagacctccaggcctcagtgtccacatatcagggtgcaatgccacctgctcctcatcgggaactagagaactatgcccacttcttattcagcttctgaatgaagggtgggtggtggatttctgcttcccaccatccggtctgtgaaaactcactcaaatgcaggataagaagcagcaggctgagcatggtcagaagcaggaggtgggaagaaaaactatggaaacctaccttggcatgaggggaactgcattttttggtacatctccagagaatagtgttgaagccacatttcgacaaaaacctgcaaaagagcattacgtagtcaaatcattctcgataactgccaagaccattcagtggggaaaggacagtgtctcccataagcagagctgggaacacagaacaccctcatgcagaacagtgaagctgggccctgccctcacaccatcgacaaaaactaactcaaagtgggtaagcggcctgaggataagaactaagaccataaacttacagaagaaaacatgggagaaagcttcataacactggatttggcaatgatttattagatatgatgcccaaatcacaagcaacaagcaaaaaaatacagcatcaaaagatactactgatagagtgaaaagaaccagcgggcatgatggctcaggcctgtcatcccagtgctttgggaggccgaggcaggtggatggcttgaggccgggagttcaagaccagcctgggcaacatagcaaaaagttgtctccacaaaaagcacaaaaatttgctgggtgtggtggggcacagccatagtcccagctactgggagtctgaggtgggaggatcgcctgagcccaggaatttgagctgtagtgagccaagatcatgccactgcactccagcctgggaaacagagcgagaccctgtctcaaaataaataaataaataaataataaaataaaaatagaagcaactccagtgttcactgagagatgaatagataaacacaacatggtacatccgcacaagggaacactatgcagccttaaaaaggaagcaaattctgacacatgctgtaacatggattaatctcgaatccattatgctaagtgaagcatgccagtcacacacaaagaagtactgtgtgctacagaaaaatgctttagatatgagatctaggagtcaaacatatagaaacagaaagcagaatagtggttgctaggggctgcgtggggaattaattgttcagtttctttttttttattaaaagagatggggagccaggcatggtggctcatgcctgtaatcccagcactttgggaggccgaggcgggtgcatcatgaagtcagaaattcaagaccagcctggccaagatggtgaaaccccgtctttactaaaaatataaaaattagctaggcaccgtggcaggtgcctgtaatcccagctactcaagaggctgaggcaggagaatcacttgaacccgggaggcagggattgcagtgagctgagatcgcaccactgcactccagcctaagcgacagagtgagactctgtctcaaaaaaaaaaaaaaaaaaaaaaaaaaaagagagagagagacggggtgtcactatgttggcgaggctggtctcaaactcctggcctcaagcaatctttcccaccttggtctcccaaagtgctaggattacaggagtgagctctcatgcctggtcggttcagtttcagttttgcaagattctggagattggaaaggaagcaaattctgacacatgctgtaacacggattaatcttgaatccattatgctaactgaagcatgccagtcacacacaaagaagtactgtgtgctacagataacaacaacgtgaatgtatttaatactactggctgtacacttggaaatggttaagacagtaaattttatgttatgtatattttacaattacagtttttttcttaattaaaaaaacgaaaagcattaatgctttggtccaggaaacagcagaaccttccagttctgtcctgttgtaagcttgtgtcatggtctcctgccctcttcacagccagcacatcccatggtccacacagccaagagccatctgggtatcatggtcccctctggggaccatgcccctcccagggacaatggtccctatcattctagcacccgaggttgttgtgaaatggtgtggaggcttcaaaaagcacggcaccccacatattaggagttatgtacaaggtcggagacagaatcctatcttatctacttcccaggtgtcaacggcgaggctgtggctaccaagtcagtcctaggatccagtgtcaggagcagcacctgccaaatctctccaagttatgctcagaagacacagccaggacctggtggatagcactcagggagtgagccagtccacaccatcgtgagaggctggagccccccaggacagacaagggactctgtcacctactatttggatcccctgaatcaacagaaggcctgtggaggctgcacaaacccctcaccattccgtgtcacaaaagtgctactggggcaacgcttaatatccacatgatggtaatcataggaagcatctccagcaacacgagagacggacaccaagagaccgcaacaattatatcacaatgggcaaatgaaacgactccgatggacaggggatcctgggatgaaaaacaccatgaatgacaagtaagttaggtgggtgggcagacttatattcatgttttctaaatgtcataccaggaaaatgccaacaatttagaatcagccctgggctaagcggccgcctctgggactctgacccatatagtggaagatggctgaccagtttcttttgaaacagacgttgagaccagctcagctctcacccggagcagagtttctgacctccagatctcctgggaggcggggtctgcattcacagacatctgatgagagaagtgtcgcttcagggggctagtgtgctggaggctacaggaagcaaagggcatggctggtgtcctgagggagacacggaaacaggcccaaggtaggagctcctgctggccaggccaggggcgatctggacatcaaaatcaatgacagcagggacgtattacaacttgttcaattgcacaatgcacaaacctcacccctgccccaaatccacactgatacacctgaataaacaaatagcaaagagaaaagtcttccttcccgcagagcgaccactgacccaatacaggaagaatgaagttagggaaccaccacttggcaactgccctattaatagcttatttggtcaagaatcaagtgaggccaggcatgggacctgcgtgagacgcctgaaatctcagcactttgggaaaccaaggcaggaggatctcttgaggccaggcacttgagaccagcctgggcaacacagtgagaccccgtctctacaaaaacattaaaacatgaaatagctgggcacggtggggtgtgcctgtagtcctaactacttagaaggctgagaagggaaaatggctccctccttgggcctaggagttgaggctgcagtgacctatgatggcaccaactgcactccagcctggggtgacagagcgagactctgtttctaaaaaaaataagatgtccagcttgggcaacatgggcaaaacccatctctattaaaaaaaaaaaaaagcattcagatgtggtgatgcatgcctgtagtcccagatacttgggaggctgaggcaggaggatcacttgagcctaagagattgaggctgccgtgagcctagatcatgccactgtacttcagcctggggtgagagaacaagatcctgtcttaaagtaaaataaaatcaatttgaaaaaaggaaagaatcgacttctctgtgtatggagtagcccttcttctattcctttactttcttaataaacttgctttcacttaaaaaaaaagagaaaagaatcaacagttgatgttaatactagtgataatacatagtctctatacatcttcccggtaaatcatcattaccaatttttcttttttttgagacagggtctcattctgttgcctgggctggagtgcagtgctgtgatcacagctcactgcaacctcaacctcctagacccgggcctcccaagtagctgggaccacagtgcacaccaccatgcctgcatgcctggctaatgtttttctttctttgttttttgtttttgttttttttttgagacagactctcactctgttaccaggctggagtgcagtggctccatctcggcttactgcaatctctgcctcccaagttcaagcgattctcctgcctcagcctcgttagtagctgggactacaggcatgcaccaccacgcctggctaattttttgtatttttagtagagacggggtgtcaccatgtttctcagcctggtcttgaactcctgacctcatgatctgcccgcctctgcctcctaaagtgctgggattacaggcgtgcaccaccacacccagctaatttttgtatttttagtagagatggggtttcaccgtgttgaccaggatggtctcgatctcctgacatcgtgatatgcctgccttggcctcccaaagtgctgggattacaggcatgagccattgtgcctggccaatatttttctttttagtacaaacaaggtcttgctatgttgtccaggcactcattactaatttttttttttttgagatgggctctcactctgtagcccaggctggagtgcaacagcatgatcttggctcaatgcaacctctgcctcctgggcttgagtgatccccccacctcagcctctaagtagctgggattacaggcgcatgccaccacgccaggctaattttaaaatttttggtagagataggattttgctatgttgcccaggctggtctcaaactcctgagctcaggtgatccacccaccttggcctccctaagtgctgggattccaggcgtgaaccactgcactcagcctcattactatttaatctgggcacgaagtacttattttacagtggacaaacctggccgacaccctttccacccagtgataaagctagcatcaccagtgatggggcaaaggggcactgcaggcctcctgatgagacacctggcaaggaccaggtgtccccgctgcagtgctcctgccaacaaagcccaagctatgcctaatcaccagcaaatacaagacagcccaaggggtggccacatgctttggaggggtcaaggtcaggaaagacagacaggctgcagaaccattccggactgaaggggactagaaacatcactgcatgcagtgggtgagcctgtgctgaaacccagccaggtaacgggcatgagtggggtagctggtggtgaaccccgaggtctgatgactaggtgtagcctggtggcaatactaacttcctggtgtggtggcatgtgctggcttgcacatgccagcagatctggggtgggccagcatctgcagaaacgggcctgtatgcagcctcctggggaaggcaatggggcagcaagattaaggagggtcagaggagcacacgcactgtgactatataagataatgcattcacttttaggaaatacactgacatattaagaggccaaggggtgtcctacctgtagtttattcttattggcttaggggagaaaaaacatatcatagaaaggggataaagcagatgcagcaaagtgttaatttggaaatctggatgaagggtctatgaactttttttttttttctgaaacagggtcttcttgtgtcaccccaggctagagtgcagtggcgcaatcatagctaactatagccttgaagagtgcacaagagatcctcccacctcagtctcctgagtagcttggtccacagttgcacgtcaccatactcagctgattttattttttgtagaaatgaggtctccctatgttgcccacactggtctcaaattcctggcctcaagtgatctttctgccttggcctccctaagtgttgggattacaggagtaagccaccatgcccagtctgcaagttctttttattatgcgtggaaacttttctgtaagtctgaagttatttcaaaataaaaagttagctaggtgtggtggcctgcgcctgtaatcccagctacttgggaagctgaggcaggttcaccctcccaatccgtgcagtatggcatcaggctcagcctgtttggtctggcacaacaggctctttggcccagggcctccccctctcaagacctgctcctggggccaataaaggattgtggaagctaggagttcaagacccaccagggcaacacagcaagcctcccctgtcatatctctacaaaaaaaaaatgttttaaaattatctggctgtggtgatgcgtgcctgtagtcactgaggtgagaggatgacttgagcccaggaatttaaggctgcagtgagtgacgactgtgccgctgcactccagcctgtgtgacagagtaagaccctgtctttaaaaagacataatgactgaatgtggtggctcatgcctgcaatccctgcaccttgggaggctgaggcaggaggatcatttgagcccaggagttctagaccagcctgggcaacatagcgagacccatcttacaaaaaatacaagctggatgtggtgttgcacacctgtaatcccagctactcaggagactgagacaggaacatcacttgaacctgggaggtggaggttgcagtgagctgtgatcacaatactgccctccagcctgggcaattgagcaagactctgtttccaatatatatatgtgtgtgtatatatacacatatatatattatacacacacatatatataacataaatgtgtatatatacacacattatatatatataatttctaaaagaaaaaattaaattacaaaaaaactcaaaagctgggcataaaaaccacttggcaactgaattgtacatctgagagggtgtgaatccacctcacctccaagtcctccacagcatcagcaacatttcagggtcactgaccactgccgccacccaggcagcctctcctccttgctgctccctttctcccctccaccctctggggcatctgtccacacatgtgaattgtaggtagaggcctgtcctggcttgcacatgccagcagatctggggtgggccagcatctgcaggaaggggcctgcacgcagcctcccagggaaggcgatggggcagcaagattaaggagggtcagaggagcacaggcagctgctgcctgtgcagagggtctcctgggaggtccccagagggtctcctgggaagtcagccaagaggccctgggttagggcccactgagaccccagcacagctaggcacaagagcccctggttcacacttcccacctgtgcagtcaccaacaggctcagcttgtttggactgacacacaggctctttggcccagggcctccccttcaagacctggtcctggggcccagagagatttccatttttttttcccccatagaacaagccttctgccatgctcaccacctcagacactgcatgtggggagggctgcttcatgcagaacacagcccattcccatgcaggccgtggaggcctccagagacctgatagcttcagtgatggccacagacatcgaaaactaaaggacagatcaccctcctcacccccaccctccagtctgtgctaagaaagctggaggtggggaatgaggcataagacaaatttgggaaccctggacaaagggtggcaccattgtcctggtgggtgattcaactgaccaggccactcccttatggaagggccaggtcttcacaatcagggtagccttacctgggagcaggtgagggactggcccatcctgggctggaggacagtgagggtggtggcaggctgcctttggtgggcaggaaccatgacaggtacctgtccaccaggaggaaataggtacagtctgaaatatggacatggagagacacagggagtggctggaaaaccaagctagttcttagcatggggtctgggcactgcctggccccagagcactggcaagtgcagggaagccccgggccatgcccccacccctcccagcaagaggcatcccttccctacctttagtgtgttgaggctcaaggcaaagaagcatatgtaatactcgaacggatctgatggcagcgtcaagggcaaatacacagggttgctgggaaacccccagtgttgagagctgagccacccacaaccttcctacctcaaggccaccaaaggatactcaaggccaggttcaggccaaggcccttagttgggcggaactggatcttgtgttacagaggactgtcaaggacgcactcctggatggatgccttcacgagaccctgcagagagaggcagcaaggcttgtgggcaggcactggcgtgtagtgcccggtacgcagtgccccacatgcacagcagccctttgggaaagctgctggggaagagacccgcacacagaactcacctgtggggacagtgccctgctcctgagcagtgcctcaacaagagtctttgctcagaacttccaccatctcataaaaagctgcagacaggccaggtatggtggctcacgcctgtaatcccagcactttgggaggccgaggtgggcagatcacaaggtcaggagttccagaccaacttggccaatatagtgaaaccccatctctactaaaaaaaaaatacaaaaattagccgggcatggtggcatgcatctgtagtcccagttacttgggaggctgaggctgaagaattgcttgaacccaggaggcggaggttgtggtgagccgagatcgtgccactgcactccagcctggcaacagagtgagactttgcctaaaaaaaaaaaaaagctgcagatggcaagggtagcagccatgcaatacccatctcctttgcctctcatacccccggagcaaatcactccttaatttgccctcagaggaccggaggagactgcccgtcaccactgggctgtgcaaggtccactgcccgagcaccactctcaccactgtggtttacttatgggcaggtaggagatgggaaagtcaaacttaagtcttcagcttgaagcttataaaccaacttcatcattgggccgctgaacatgaaattgaacaaacaaaaacagggtatatgaactgcaaattatcttgctttgattgtatcttaaccttaagaaattgagagtgacttaaaagtggaatcaccatgaggaagcaccctgcctctctcgggtgtcaaacctaccttcccagggtcgagaaattccatcaccatgctgtacttcacaggattcacgcgcctctgtaagcagcgcaggttccagcccacaaggacaccatccaggctgccgaaaatgctaccagccatggggagatggcgtgcagctcctgaaacagtgtgcggtgaggctgcaggcaggaccagcacccactcctgccccagctccaggcctgcaccacctgctgcccagctccctctgaggaggccactccctggctgagacccatgggatcagccctgcgctcaaaggaaccctggtgcggtgatgccaatgagaagagcagctttgggttctttcactggggtacgtggcttaccaagcagtgctgctttagacgtgggccagttaagtaagtcagcctctgatcaaaatacattttttgtgtgtgataaaagcctaaattaagggaaaaaaaaaacaaaaaaatgaaaaaatgaaaaataaaataaaataaacaaaatacctattcttttgagacagggtctcattctgttgccctgtctggagtacactggcgcaatgcacagctcactgcagccttggcctcctggcctcaagcaatcctcctgccttagcctcctgagtagctgggactgtgggcacacaccaccacgctcagctaatttttagatttcttgtagagatagggtcccagtatgttgcccagactggtctcaaactcctggccttaagtgatcctcccacctcagcctcccaaagtgttgagattacaggcatgagccaccacaccaaaagattttttttttaatgtcagaaacttctgatggatgcgaaggatgctctattagaaaggaaagcaacacccttcccagagtgaagcccttaaaatctaactgacctgttgtcatttggtattaactccttgtctaggccagcttcctgggcttgacaattccaggtgtgatttaaatacatatttttagcatttacatcagggttcctcaacgttgatgctattgacattttgggctggattcttctttgttgcagggagctgtcctgtgctttgcaggatgtttccagcatccctggcccctacttactagatgccagtagcacacactccccatcacccccagttgtgataatcaaaaatgtctctgatattgccaagtgtcccctgagggacagagcacctgtggttaagaactcctgatctgcaagttcacatatttaaatgtgtccataaacatgacggtcatgataatgggccaggactctgtgccaggcagtgcttggagtgggggtggtggggggaattaggaattataataaagtttttaaaggaatgtgtaagacatgctccaaagagagatgtcagcagagctatacctctgctggaaaatcctcaatgactttaaccaagtcttggcatcactgtgcaaagggcttatttacagagtcagctttcagggtagcctagaaggtagaacaaagtgaaaaaatcatgaggacattcactgcagcttttagtgatactctggcttgagtcaaacagaaatccaagtgataggttatgagtcagacacataaccactggcgtgattccccagcccctcatgtgtgtcagtggcccaaaggatgctactaggagaggctgtggttctatgcactctggaccaggaactctcaggcttgcttcccagtaccaactcagcgtgctgctcatcatcagaacaggactgacttccaccaatccataagtaggggttggccccagggtcagccccagagccagaagaggatctcgattgtgtaagggcacctctcacagaccacagagtactactgagttcgtacgcatcaaatggaaatttcccacctgatggaccatcatgattacacagttgtgatcatcagtaagaatgcccaacaaaatcagggctacagcatcctctcttaactgagctgtcttttattcagcagacagtgaacctactaaaccaatgaccttaaaacacagggcagggccgggcgtggtggctcacgcctgtaatcccagcactttgggaggccaaagtgggcaaatcacaaggtcaggagttcaagactagcctggccaaaatggtgaaaccttgtctctattaaaaaaacacaaaaaaattagccgggcttggtggtgcatgcctgtaattccagctactctggaggctgaggcaggagaatcgcttgaacctgagaggcagaggttgcagtgaactgagatcgcaccactgcactccagcctgggcgacagagagaaactccgtctcaaaaaaaaaaaaaataaaacaaagcaaaacaacaacaacaaaacacacacacacacacacaaggcaggtaaaaattatagatggcttgcaccaagtaaacactaaacataaaggcaatggagaggccagaaaagactcaggacaaggactaataaaatctacccacagtcgtgggatatacggaaagcatcctgactacaaggataaaaatagcgtctgtgcaaatggactcacatcaggagaaactgctagaatctgtctacctccaaatgccttgtctacctccaaatgagggtggatttcacaggatttgagacaagagatggagacctgagttgtctggccatgtggcagacctggtggctctagtggggtgccctggggaggaacgtccttccacatacatatttacaaaaatacctcctaagaactaaaattaggaactttcatcaccaatacttgctcatacctaacttctcgcttctcagtatcattttttcttttttttttttttgagtcttactgtgttgctcaggctggtcttaaaactcctgggctcaagtaatcctccttcctcggtgtccttagtagttagaactacagatacggaccattacacccagttctcagcaccatgtttaatagttaaagtgctaacctagcaccccctcagaacataagagtgtctccatttttcactaatgacaattatgattatcagaatgtttcatgtctgtttaagaacttacagatcatgaacactctgatgtacatcattctcatttgctcctccccctcctcctcctcatacccccttgggaagtagagaaaatagaacttgaatgaatttgtcttgtatgggaaaacccagagcccagagcccagcggttgagtaaccccaaggccctgtagtaataagggggcacagtcaagcttaaggagtctggcattgcttccatcacacgctcctaaaagacaaccactagagaattcttcaagtcaatgggaagaacattcaagtcccacagctacagagctgtggccacactgacactcatccagacagctgatatttaccagtagaaagctgggccgctgcaggtgagggaacgccataaaagcctccagtggagagttgaaaatggccttcttagcaaaccactgtggaaaaacagagacaaaatctcaacatctgcagcacagcagaatctttttatttttctagagacagggtctcattctgttgcccaggagagaatgcaatagcacgatcatagctcactgcaacctcaaactcctgggttcaagcaatccttccccctgagcctcctgagtagctggaactacaggcacacaccaccatgcctggctaattttcttcttattttcttttttgtagagacagggtctcgctatgttgcccaggctagtttcaaattcctggcctccactggccctcctgccttggcctcttaagtgctgggattacaggtgtaaaccactgcacctggccctaacaaaatattacatagtttcacaatgcccaggagaacatttgtgtaactcaacatgcattacattatcgattctcatgtcttctttatttatttgtagagacagggtcttgctttcccactcaggctggagtgcagtggtatgatcatagctcactgcaacctcagactcctaagctcaagcgatcctcctgcttcagcctcccaaatagctgggactacaggcacacaccaccaggccctgctaatttttatatttgttgtagagatgtggttacatcatgttgcccaggctggtcttcagctccagggctcaagtgatctacttgcctcagcctcccaaagtactgggattacaggcgtgagccaccacgcccggccagcaattcccacattttacagaaacaccattcgcatgcagcccacagtggccagcttcagagccaagtctgtggtactgaatccttggtaatgcttgtacagcacttgctgtatgccaggacttgctctatacaccacacacactgtcagtccccaggaggggaatgtggtatgtgatgcttcataaacacattgaactctttctgccaaggaacagccattaacaccttggggttacttgcaactcacctgtggactgttggtctgagctattgtccatcacttgcaactcagtgtacacaggttcatcagagctggtcccaaaagcaagtccaagcgctggagagcatgagtgggaaatctcacttccacctcggatggagaaaaacttcagcaagattgtcattttatctttccgacccagatggactccatcttgactcaaagacaaccagaacatcaccaagcatctcctacagggcaggcttggtactaggtggttttatttagattatttcatggaatgttcaggagaattgctccctcttcactcctgaattcttgatgcagttcttccactttcgccctttcttctcgtctctgtctcattcagctccctcattacaaaccttccaactggctggatggcgcagttgctcaaccagcagagagcactggggtagccccaaataaatgttcatgtcatctccaaattaccagcactattcccaggtcccaattcaagacaaaaccttatcagcctcatcagtgagagcacgttttcaccgagctgagtaaaaacttaggtacaagaccattcagtggggaaaacactcatttctttgaagaatggtgctgggagaactggatatccacatgcaaaaggatgaagctggacccctacatcacaccatatacaaaaattaagtcacaataggtcaaagccctaagtataaacactaaaactgttaaactctaaacaaaaaacatggaattacattttcaagatcttggatttggcaatggattcattcttatttggtttttaacttcattgtgagccaatttagcatccaaaattccagtaggtttggtaaaaattgacaagctgattctaaaattatagcaaaaatgtaaagggcaggccgggtgcagtggctcacacctgtaatcccagcactttgggaggctgaagcaggtggatcacttgaggtcagtagtttgagaccagcctggctaacatggtgaaaccccatctctgctaaaaaaaaaaagaaaacaccaaaaattatccgggcatggtggagtgtgctgtacctgtaatctcaactacttgggagactcaggcaggagaatcacttgaagccgggaggcggaagttgcagtgggccaagatcatgatactgcactccagcctgggtgatagagtgactctgtcgaaagaaagaaagaaggaaagaaaaaaaagaaaaagaagaaagagagagagagagagagacagacagacagacagaaagaaagaaagaaagaaagaaagaaaagaaagaaagagaaagagaaagagagaaagaaagagagagggagggagggaggaaggaaggagaaaaaaatgtaaaggacaaagaaaatctagactcttcttaaaggacaactcacctcatcctggtcatcttggcgtcttcatgattatgagcatgaggacttctagaattctctctctctgtcccctgtcctctctaggattccacagtcttcccaggtgaccaatacttgggatccacctttcaggcaaggtcctcttcttacccatggggcttacatatctaatccagtggttcttacccagagctgtgcactggcaccaggacaccccaggcacacttggggcagcccctagagattcggttggtctagtttggagtcttcttccacaaacgcgactgtgattgatttacatctgtgactgaatccctagtgaagatgcctaattgcagcacagtgacctcagtgacgctagccctaagcatagccacccagaagaacagggcatttggccaagcgagagtggtgttctgaggagggtcctggtcacacacctccatctgtctccacacctgtctggccatctgggcccagctaatcggagtccagtacctcttttcttggtctcaggcccacacagcttcactcttcgcatgtaagccatgcccctctgaatttctgatgccactatcttatctccagtgctggagttactacttctttcagggaacatcacaattctttccgcatttgaaacttcccactttcaaaagttttgtctttctcagtgtcacctcctctgtctaagggtagggcccaggtgtgagaagcagggaactaagagaaccatcctgactctcggggagctgttctgccttggcccgttgctgtgaggacacacgtccatggtactgagacagccaacagccctgggaaccagaaacctcaccctcctatgagcaggtcatggcaggtagacacaagccttgttctgggggccaggctaagaatgtcccatggattgaacagtagagacattgaccctgtttgaggtgtgaattctagatttgagctccagcagtgcagttagaagcagccgacctgcctctagttcctaagccctcgtacccatcacactgttctacagaagtggccacttgatcccctaaagctgtgccctcaatggacactttgttcacatttaagtgaatatgatccttttaaaaattaaaaatacatattttaaagatagtcttaccctgtcacccaagacggagtgaagtgggatgaacacaggtcactgcagcctcaattcctgaagttgaggagtcaactgcctctgtctccaaagtagctgagactacaggcgtacaccacacctggtttcattcaggtgaatataatctttgctgccagcatctcaccctttgatagtaatcacatcctcttaagagggctttggaaacaattggccttggctagccaatcccaggttttcgcttccatgagggtctccagcttcacacaatattgtgcccatatctgtagcggccttggtttttaattgcaaacaacagcatccacccacatcagtgttggtaaaaaataaattgcttttttttttttttttgagacagactctcgctgtcgcccaggctggagtgcagtggtgtgatctcggctcactgcaagctctgcctcccaggttcacgacattctcctgcctcagcctcccaagtagctgggactacaggtgcccaccaccatgcccggctaattttttgtatttttagtagagacggggcttcaccgtgttagccaggatggtctcgatctcctgaccttgtgatccacccgcctcagcctcccaaagtgctgggattacaggtgtgagccaccacgcccggccaaggtattgcttctttaagaatggagctgttaatactgctggtaccagaaacattaaaaaagaaaaatcctgcatgagggccagaggaggagtacaggagagtgagatggagtggaatcctccagtgggtgatagatggatggacagacagatgaatagacagacgaacagatgaacagacggacagacatgaataaacaggtggacagacagatgaatagatgaacagacagatggacaactggatagatggacagatgaaactaataatctgagaaatcagaaaagcttcatgaaaaaagtgggactgagctgtgtctccacggatagatataaaagcagaggactctccacttgagtcgagaatgacccagtgtcctgatccagagaggaagccagcctggcttgactgggaaatttgtgggaggactcagaggcccttaaaatgaggccaggtgaggttgggctgatccgagccagctcaggactcctctgccacacagcacagctgccttaggggacacattactcagggagttgctgggacctactgggcccagcattgccaccagcaccaacagcttcagagaggggggacacacacttggggtgactccaagactgtgggtggcacctgcctcaaacaggggacaggcacagggacacctctcggggtctggcacccccacgcactgtgcctaggtcccaacaacgcccactgcagccctgtgcccatcatgcccagaaggtttccgcttcagcctggcccctgtactggccccaggaatttggacccaagcctcagtcactgggtaaacagcagtgggaaccagctcattactctaggtaagtggctcttacaaccttccccagccagttccaccctctgttgtctctggaaaatatgttttctctccctggggtggcttctcctctgccctcccagccttaatcactgacccctacctttctctatgggtcctgggggaggtgggttagtcttgaggtaaccagcagaagggccccaggttccaacagccagacgcagcctggtcccggggcctgggctgggtttaggcaaggtcagagttccttcacctctttcagggcaggcacccgaggtgcggggcaaaggccagttctgactggcacactgcagtagcatcagagacaccccccggaccccagggtctaggctgatggctggatgcccatccagcctgggaaggccacacgggggcctggggacaaaggggtcaccatgaggtgacatcaatgcaggtgcagagagggctctgggtctaggctgcagctctctggcctctgctgggtcatgaggacacagggacaaaaaaagaagatgggtcagatggggcaagatggccagagcccagccctcccagaatagtcatcagagaggagcagatcccttagggcagagacatatttgtccctggagccccttcacccctggggcctggcgtctcactgtccatgggtcagtctcccaccttcctcaaagggcacgttagactcaggaggtgacaagaggggagcgaatggggggtgcagaggactctacggcagccagctgaagtctagagttgtcagagtccgtggaggcaggcatggggggctgctgtgtcccgtggtccaggggagcagccccaacaccacagtggaggtgaagggtcctatggttggggtggtggggacaagggaggtgaagagcggtggaggagccccggggcttgtctgggtgcagcccacccttcatcaggaaagctgaatgggatgggctggggcaaagcctggtgccccaggggacaggaagctccaggccccaccaggcttgggcctttccacactctgccaggatagtcctgtgggctgggcggggacgtgcaaattccaaactcagactccagagaccagagaggagggagcacagcctgccctgggtacacacagggaaacagaggctgcagaggagggctgggccagggctcctagaaaaggtgacttgggaagagctcctaggaaggtgcgggctggctgctctgcagaggtcttgagtgaaaaggaggggaatgaggagggaagaggcagccccgggtggactggacagccatgccgtgaacctcacagagactttagacagagagggggctctacaacaccccagtactccctctgcctctcttgccccctcctctgtccacacaggtctgcccaaggccgcccctttggacactctgaggaactccaagccaacaagatgcctctcattagtgacttctaccctgatgccgtgatggtggcctggaaggcagagggcaccaccatcaccctgggcatgaagactgccacaccctccaaacagagaaacacaagtacacggttagcagctacctgaacctgacgtctgaccagtggaggtcccccagcagctatgttcttaggcccctcaccccacccacagcagccaggagctgcaggatcccagggcaggggtctcccctcccaccccaaggcatccagcccttctccttgcacccaataaaccctcagtaaatatcctcattgttaatcagaaattctgctccctgtcttcatttcttacctttcatataatttgacacttcccccaggttctcagtgggggatgggggaatcctgacactcagtgggaaaatagcttgtgggagaggctcccaggctcccaggggcatctgctggagaaacaggccaggcaaggagcaatctgatcactgaagaccagtccctctgccctctccctcctccaattccccgctgcagcactccctcccccaaccccccgccactccctgcctcctttctggatggagctgtccctggctgggccttcagatatgccctctgtccttgccctagtaaagacactcttcccacctacgacctctttttcctcagcctggaagtaacactctgggcctggagttcctctgcccgtggccctggcccctggaatcccctcctccctctctgcccaactccccacccctgagagctggactgtccagaatactccagcaccttcaaattcatgagctgttaaatttggggcccacctcgattcttcacctgccagcaggttcacaggtgtaagaaaaatcggaggaaggcaagaaggaaacacacacaaaaggcttgcaggaggctcaggacacttgccaaagataggctctaagctccccaggaaccagagcaagaagggtaacaggagctccatcatttctatgagatttaacaaagcctttgcttgagggaagttggtgttttcaatgctgaggccaggcatctcctcagaactaacagtggggatgtgttttttgtctgtttgttttgtttcgttttgttttgagacggagtctcactctgtcgcccaggctggagtgcactggtgcaatctcggctcactgcaagctccgcctcccaggttcacgccattctcctgcctcagcctcccgagtagctgggaccacaggcgcccaccaccatgtccggctaattttttgtatttttttttagtagaggtggggtttcaccgtgttagccaggatggtcttgatctcttgacctcgtgatctgcccaccttggcctcccaaagtgctgggattacaggtgtgaaccaccactccaggcagtggggatgtgttttacccaatcccttagtattgattggatttgggctccgacacctgcacaggtgactgcctggcagccccagaacacggagatgttctcaagtgtgtggcacagaaagtcactggctgcctttggggggcattctttttgggaaacacctctccattggatcctgggcctcaggtggaaaaccaggtcctgcctcgggactttctctgtgaggctccctgggtctggggctccagccattctccgagaggaaggtgccaggagagagagcaaggcccagccccacctagtctttcctgcatggtccctgctctggtagagacagggtttggcctggctgggttccacacctgctgaaggatgcacagatggtagatgcccagtctgaccctgggtctacccagggctaacccccttccctgaggccagactgaggaggctgagcctgcccaggtcctgcaggtgttcagggcagcacagacagtgggtgcccaggcccctgacccaaggtcacccttccctcttgaggctgtgctaggcagggccaggagacagtactgaacacaccaatccccttgtggctctgtggggttggggacctacactcctcagtctacatcgagccggtgtaggagacaggcagaagcaggagggtcctcggagtccacaaagcagagcaggggcaggtgctcgtgtgcccatttcaccgaagagagaactgaggctccacgggaagggaagtgacctgcccgggtcaacatggtgagctgctgcctgacccacccccagcctctttccacagctcctcagtccttcattcattcactcacacactcattcagcaaaccctcagtgagcacagctgtgggccaggtgctggtgcaagaccaggaccacctgccctggagaagctcatgagctggaggacaacagggagacaccactgcacccccctgtcctcaagtccccaaggttggagcttggcccagggagcgcctggggcagcaggggcatctccccctacttagcagaagatttaactgaaagaaccatctgacggagccccagctgtcatccctgggccacagtgggaacatcacagtccctcatcaaccctcacagtgaccctgaggcccagggcagccatggtccacctcacatagggcaggccgaccatgaggaatgcaccacggttgcctcatagcgaccctgagctctagagctgccattgcccaccttatagaggggatgctgaccaggagggaggcaccaaccagggccacccaggctccggccagcctgagagtggcccagctggccctgtgcctgcactgccctgcacctgctgccctgcccagctcagaccctggtcatatcctcaggagtgatggccccacagcaccagggcagggtaggtccacactgggagagcccctaaaggtacagagaagagcactggagtccagggaggagggattgtcccggccctggtcctgcctcgctgtgaccagggctgaggcatttgctctaaatcagatgggggaggggcatctgtggcttcctctacagccaaaaccagagccccaaatagccccggtgggtatggaggggccttgggggaggggaggaaatgggaggggaggtggctgcttggggctctgggtgagggctaggagctcctactgagctaagcggatgactctcctatctgacctggccccccatggggcctgcaaaagcaccaagagagcatccccagccaggcctgtggaggggcccttgacccctcatactcactgagcccagtggtgggaagagggggctggtccccggccagtattctcctgaggacaccgacactcactggtaacaagcaaaccagacccagatgctccaaaaagaggccactggatcccagcaagcacccactccccccaacacgaaggtccaaaaccaagcttcagccaactagaatgtgggaacttcccgggaggtagaggaaacaagtcactgtccacttgcaatgcccaccggttagtgacgcagcacaatgacagtcacacctctcagagggggctctccctcgactctccttcctgacacatcaacaaggacagccttaccaagggccacacctgggcagtcaccatggggttcgtggtctcacgtgggccctgcttaaagcccctggggataagctcactccagctcatgagaggccgggggtgaccctgaccccattttccgatcagcgatagcacagcacatgtggggaccaatgagaaatgagtctggggagaccacgggcttcagggagaatgtttcgatgaggcaagtacaagagccagtgagggactgggtgacttctgtggcctgtgtcacagagctggggccatcagatgccccatgtccactctgaggacagagtagcccatggttaggatgacccaccagccaggcctggccagggcacccacaggagacaggaaggctgtgagggcccgggggcacggagcagctctgaaaggaaggggtgctgggtcccggggctcctgggcagagtggttgaagaaggtgagaccccagaccagccagatgggcccacttctcaggggaccctggtcagacaagggagcacctcctgctcatggaacacagcaaggggcaaggtaggcacagccaggctcggagaactcgtatttgggggagatgtaaatcaacccaatagacaagggagcgatgtggtgtaggagatggggtttgtgctggggagaaataaggcagagagtggggagtagagagcacctgtctggggtctcaggaggagcgatgtcccaagactggaggcggccaggggctgaggagccctgactgggccaggcctgtggctggagctggaggctcgggttcagcctcagtttcccctctgtgaagctaggttcataataatggaaattgactttctgggtggctggagagacattcagatggaaaatggatattctattttgtctctgtccttggttgttgtcatctcaggctgttccagccccagttagcctcgggtcagccccctgcccatgttggtctccccatgagctcaggcacctcatccccagcacagctggcctggagaaaccaagattccctgaggcttaaaatagctggaaagccagcccagctgcaggtgcctccctgtaggataaaatgtaggagaagatcttcaagagctaggactaggcaaaattttcttagacttgacaccaaaaacatagtctacaaaaggaaaaattgctaagctaagtttcatcaaaatttaaaaatttgttctgcaaaacaccttgttaaaaagatgacaagttacagactaggagaaaatattttcaaacaacatatatgaacaaagcactgttatcttgagtatataaggaacttgcaaactccacacaaaaaatcaaacaatccaattagaagatgggcaaaagacacgagcagacatttcaccagagatgatacacaatggacaaataagcccatgaaaagatcttcaacttcactagccatttgggaaatgcaaattaaaaccacaatgaaatataatttacacacatcagagtggctaaaataaaaaatagtgacaagacaaaactctgctgaagatataagtgtgaatcactcatatattgctggtgggcatataaaataccacagccactgcaaaagtgtggcagtctcttttttctctttagagacagggtctccctatattgcccaggctggactcaaattcctgggctaaagtgatcctctcgcctcagcctccagagtagctgggactaaaggcacatgctactgttgatgtttggcagtttcttatacgactgaacatggaactaccgtatgacctagcaattacattctgactcatctatcccagagaaatgacaacctgtgctcatacaaacaaccgtacgtgaatgttcattacagctttaatagcaatagccaaaaatctagaaataactcagccatccatcagcaggtgaacagttaaactgtgctacatccatcttatggaatagcactcagccatccaaaggaatcaactcttgatacactcaaccagctcaaccctccccagaacgcacctgggtgggaaggtgcacagcagattgggccactagatttacccagtgtggaggaaacaggtacctcctcctagattttgttcttggcagagataaaccagtgcttctcagtcatttttgctttttactagccatgggaggtattttccagtaaaggcttctatgaccaaatgcatttgaaggaatgttccatatgctctcccacacgccttcaatttcctgagagtgacaagaataccagaatagccaaggttctaagatatccttcaggatacctgtttaacttaaacttccccaaactatttgattatgagactcttttcaagcataaacattttccttccaggaacatttgtattcttataagaaaatattagaaagcattccaggtgacttacctaatgggagaacctcaggcgccaagccagatgagataaaagtttcaaatagtgctgataaggttttcttggttcagctgcctccctccaactcagctgctgtcacacttctaggcagttttgactggactgtaaattccttctggctggggccatgtctcagcaccttgtgcaggagtgatacaaactaatgcttcataataaatacttactcactgactttctctttattcatcccaggtgagcatgttttccatccccttcaatctccacactcacgggcaaaagtgagttgtgggtcttggaactctcaagaagaggaggagatcttcaatttgcatatgcagaatccaaacaagtcatcttgagtccccacaagtaggtgggcttatttctcacataacaaaatcgcccctcctttgcagcctctacaccactgcagatcaagcccagctaaaccttgctgtgctatcctgaaggtattgctcccagatcccggctgtcagctcctgtccagcatcacagggcaagtccagagacatgatcatgtaattgaccagggatgacaagtgggtcctctcagtggacaggtgtctgcagtaggtaagccctgtcaggagaggaaagaaaagcatcatcatctaccacctgataccctttgccctgtcttatggagtccccaaagtgctgtcccacactcccatctttatttttttatttttctgagacggtctcgctgtcacccaggctggagtgcagtggcgtgatcatggctcacttcagcctaagcctcccgtgctcgagcaatcctcccatctcagcctcctgagtagctgggactacaggcatgtgccatcatgctcagctactttttaacccctccttttcttcacaaggaaggcaaggcttgatgtcacttgctggctgaatggcttaatagctctacaaccctagggaagtcttatcaccttgctcagccacagtcagggtgatgccatcctcctctgctggaagccaaaacatttaattgataggctggaggcagagaagggacaggaaagaaggtggccaatgactctgtggccttgctgtgcctttgtctgcctccaatccatacacagagaaagacactgtgagatgtggacaactttctttcaaatatcagctgaatacaggtattcatccaaaagaaaggaaatcagtacatcaaacagttatctgcatgcccatgtttactgcagcaccattaacgatagtacaaaatcaacctatgtgtggaggaatagtacagaatcaacctaagtgtccatcaatgaattgacagttaaaggaaatgtggtatatgtatgcaatggaatattactcagccatgaaaaaggatgaaatcctgtcacgtgcagtaacatgaatggaactgaaaatcattatgttaagtaaaaaaagtgaggcacagaaagacaaatatcacatgttctcagtcatacatggaagctaaaaaagtatttctcatgaatgcggagagtagactggtggttaccagtggctgggaagggaagagtaggaggggaatgaagagaagttggttaatggtacaaaaatccagttagatggaattaagttcttgtatattatagtaggaaaaatataattaacagtaatttattgtatatctcaaaatagctagaagaactgtaaagttcccaacatgaagaaaacataaatgtttgaggtgatggatgttccaatcacctcaaacgtgatagatcaatacgcagtggatctatcaaaatactacatgcacccccaaaatatgtacaactacagtatatctattacaaatttttttaaaaagagggccggccgggcacagtggctcacgcctgtaatcccagtgctttaagaggctgaggtgggtggattgcttgaacccaggagttctggactagcctgggcaacacagtgaaacccagactctacaaaaaataagcaaacttagctgggtgtggtggcgtgtgcctgcagtctcagctacttgggaggctaaggtgggaggattgcttaagcctaggaggtcaaggctgcagtgagccaagatcttgtctctaaaaaataaaatcggctgggcgtggtggctcacgcctgtaatcccagcactttgggaggccgaggccggtggattgcctgaggtcagccatcctggccaacatggtgaaaccccgtctctaccaaaaacacaaaaattagccgggcatggtggcacacccctgtaatcccagctacttgggaggctgaggcaggagaattgcttgagcctgggaggcagaggttgcagtgagccgagatcgcgccactgcactccagcctgattgacagaatgaaactctgtctcaaaataaataaataaataaataaaacaaaatcagataaaaataaaacaaaattgcagctggattaaaaaggccccagtaagtcaggaaccagggagagagatactgagggggcagcttgctttcaatgatggtcctgcctcaaaagcacacctaccaatgtgccaccccttatctgtcacaccctgtcacctggagggtgttaggcaaagtgcctcagcaaacgccagcccgtgctgtttgctctggctgtgccctttccttctggcgttccccagccatttcatcctcaattcccagtgagaaccctggacattttgcagcctggggactaaattctaacaggagggtcaatcatagcaatgatgatgatgatgatgaccacgatgatctaatagctaatacttacacagtacacactatgtgccagggagctgttagcagagtttgcataactcagtctcgccacaacccaagaaagcaggcgctactgttatttccatcttatggatggggtaagttgaggcccagactggttatgtcacttgcacaagttacataactggaatctgaaaccagatcacctggctccaaaacctgggctctcaaccaccatcagccatgagccacatcatctgatgacattattccagacccgtatcaacccccaacccttcctgcaggaagatatttcatttgggtccaaaaatacttgcccaatgcctgctccacgccagcccctgcattaggcaaaaacgtggattgtaacggaacaggcaaaacctttgtcctagtagagtcacgctctccccgcctctgcagcactcaggtgagctgcactgtggtttcacaggcccatgcaggtgtgtgtatagctgcaggttttatttccctagcctcacagcctcaagaggagagataaaatgtgtatattcagggatggaaaacacacacacattttctctctcccatcaaggctgtgaggctacggaaataaaacctgctaagaataaatatacggagaagaaaaaacaaagccttggagtcaggccagagtctgagtcccagctctgctgcttggtagctgtgtgaccttgggcaagtcactttgtctctctgtgccttagtttcctcatctgttaagtgggaacaatcagaatacagatactaggaatttaatttttaagttttgggggaggcataacgtcactttactcttctgcttctgcccatgacagaaggaaactgacatttactgagcacctacagtatgcaagactagctgccaggggctttctacatgctcctcacttaatcctgaaaacaaaccctccactgtggcacctgggggtacaatggtgatttaatgaaacctctgtccccaggggtccccattgttcactgccctctcttaggactcaggcataaaatttatccccaatctgtagatgatgaaactgaggctcagaacggttcatgtaaattcactgaaaccaggcattcaggtaatagaggaggagaggttcaagctccaaagccagtatctcctggtatcgctgacatagagtaggcactgataactgcccctcggagactacacggcaacaaagacctatgtacatccatagaaggctctgcagaggatctggtacttcatattgtcacaagagaagtttctggggagccctgcaggcagagaaggagggagatgcttagaatagattcaaacacagcccaggttttttggagaggagcacaacttgttatctctagagggtaactgaaatcagccagtcatgaggagtgcagggagggtgctattacctccacctttacaacatcacctcttccactaccagtgacccagtttgcccttgagaaatcactccgtccacaactttctgtctccggtttctaaagggatgactctacccatttataggaccaaagctggagtcatagtaatggaagcggagattgtcatatgacccaacctgagccaatgagaattaggcttgggactttcattgtaactaccaggaaaaagtctttttctgcttcagtttctaaaccagtgggatacaggacagtagctcctaggagctatctttgccacaacataaaaagggcctgcctgtggatggaaccatcacagagggaagcagagccaagagctgaagaaacagagattcccgtctcgagcatctgagcctgaagccactatgactctaagcttctgttatgccaacaattttttttacctgaaccagtctgaagtgggtttctatcacttgcagaaagagttctgatttctttttttttttttttttacacagagcctcgctctgtcgcccaggctgaagggcagtggcgcgatctcggctcactgcaagctccacctcccaggttcacgccattctcctgcctcagcctcccgagtagctgggactacaggtgcccgccaccacgcctggctaatgttttgtatttttagtagagacggggtttcaccgtgttagccaggatggtctcgatctctgaccttatgatctgcctgcctcggcctcccaaagtgctgggattacaggcatgagccactgcacccggccgaaagagttctgatttctaaagtgacccagctgaaccaagagccaaactgggattcagtatctggctgtttgctaagtaggtgatgcctcaaggattctccctgcatgggaatttgtggcaacttttttggctgaaagaggcaagaggagtaaggtaccagcattgctggataaatccaggactgctgaagggagtgttgtacgctcttgcaatgaacagaatggaagaatatcggcatatttattctcagcacatcccaaaggacatccagaaaaatccagggagactggggtgggggaaacatagccgaagtcctctagttagacatgtgaactccaaatatgagagacaggtctcagttaatttagaaagtttattttgccaaggttgaggatgtgcgcccacggtaccgcctcaggaggctctgacgacatgtgcccacggtggtcagagcagtttggttttatacattttagggagatatgagacaccaatcaccgatcaatgtatgtaagatgagcattggtactgttcagaaaggcaagacaacttgaagtggggaggaggcttccaggtcataggtagataagagacaaacagttgcattcttttgagtttctgatgagcgtctccaaagggggcaatcagatatgcatttatctcagtgagcagaggggagactttcaatagaatgggaggcaggtttgccttaagctgttcccagcttgacttttccctttagcttagtggtttggggccctgagatttactttccttttacaggcacatggaggcattgaatactgaagtgtcccactttgtgccctcaggttggtgaggcttacagttgctcaggttacatgagaatagggtcacataaacagctgtcccactgtgggcttggttttctgcaaggtactgagttccccattatgccaggtgtgtaagcagacgctgtaacaggagagagggcagtaagttatggcagcattttttttcttttttcttttctttcttttttttctttttgagatggagttttgctgttgttgcccaggctgaagtgcaatggcgtgaccttggctcaccacaacctccgcctcccaggttcaagcgattctcctgcctcagcctcccgagtagctggtattacaggcatgcgccaccacacccagctaattttgtaggttacagcagcatttctcactggtccatggaccatcagcctaacagttacttgcagttgctccaacatgtgtattcctgggccctgcacagacttaatcagaacttctatgaagtagtctaggagctggcatgttttgctacctagcccaggggattctgatgcacaataagagaatatccggtaacattagcacttctcaatcttaaaagtacacacatggtcttgggactacgttaaacacaaattctgattcagaaggtttggtataagagactgaccatctgcccggtgctgatgctggttcacaggccacagtctgaggagccaggagcttagatgatgacttcaacaatgtaatgccagccctcacaccgtacactcctatggctgaagactggaccacacactggtacagaagaccagcaaggacaatagggttccattctaccaggcaaggccaggaggaaacaaaaccagtctcatgaactggctgaatagttccaaagagacaaaagctctatgggcaaagagagagatgcgcctgagatttaagtttacatgataaaatggtaactgttatttactgaacagtactgtgtgcaggtggcatattctggccactttaaaccattatctgagctggcatttaccatagccatataaagtaagcaccagaatctccactgtgtggaggagcaaactgagatgaatgtggttgacattaaataatatttgagattattctgccttctaggctcatggtagggctgcacttcctggctccttgtggatggggccaatgagctgtgggtgggtatgacatgctaattttgggtggggcccttttattgtgggttcaagcccctccaatgctacctttccctgtcactgtgactggcaacattcaaatgatggctgctccaacagctggaccctttggtgtggaaaaaacagagcctcaccatttgacctatgagagacacacagcatgcatgataaataaaatttgttgtaaaaagctgagttttaggactgtttgttactgcaccatataaccttgtatagcctgactaatacacataagtttcaacagctagaatttcacaaggccaggatttaacctagatctggttgactccatagtctatgttcactcaattcaatgtagggaaagatactggcatccacaaatctcagccgaaccactctgtcaacagaatgagaaggacgatttccaggagctgggctgacataggaatgagaggttactcatggagacatccatcagatcctgggggactgtggtgagtagaacaagagccctggtcaagcctatgtgggtcacagaaacctcatcccagagcaagcagctcatccccaggccagcacagggatagggaaagaccctggaggtgacagcagaaaacagcagccccaattatagtctgacccaggctattgagcccacctgacccaatgaaagccaccaccaaaatctgggggctccaacagataggcagaactgatgacaactgaagagagaggaagagaacagagagagacaacagccaagaaaacaggccctatcccagagcaggccaagcctcaccatgttgtcacttagtcatgctcaaaggatgctacaggaaggaaggggcacctgctgggtgcttctgtagaagaggcaggcctcatggggtacgatgaaagggagcctgactcaacagatgaggcagggcacccatgggcaagagacccagtggagccgctgctaatgaaagaaaagggtacttgcactatccatggttctgaggctaaagctgctccaccaagtgggtctcaaacatattagtgacaatagctgtcgctttgtactgagtgcaggtaccatcattatacccttttccagattaggaagctgagacatggagagtttaaacaacacgcccaaggccacccaactaacaagtggtggagccaagatcccagcccaggggatttgactcttcttctgagactgagtcttgctccgttgtccaggctggaatgcagtggtgcaatcatggctcactgcagccttgacctcccaggatcaagcaatcctccctccccagtctcctgagtagctgggactacaagtgtgcatcaccacacccagctattttttctgtatttttttgtaaagacagggtttcactgtgttgcccaagctggtctcaaactcttgggctgaagtgatcctcctgctttgacctcacaaagcactgggattacagcgtgagccactgagcctggctcagggatgcgactctgatcttactcttcctccctcagctgtgttcccataggctcttgtggctacacaacatctgctctgtcctcaagtggggtgattctgtcgatgtctggagagactttggtttgccatgccttgtggattaactaggtgctactggtgtctagtaggtggaggtcagggaggcttctaaacactctataatacaccagacagccctcaacacaaggaatgatttggcctcaaatgtcaacagtgctgaggctgagaaaaccaatgttagaccagcactatccaacagaaatacaatcaagtggtcaaggcccggtagctcacatctgtaatcccagaactttgggacgccaaggcagggggattgcttgagcccaggagtttgagtttagcctgagtaacacaacaagaccttctacaagaaatcaaaaaattagctgggcatggttacacatgctgtggtcccaagtacccaggatgctgaggtgggaggatcgattgagcccaggaggtcaaggctgcagtgagccatgatctcaccactgcactccagcctgggcaccgaggccacactacccataggctgctcccagccagaagcgagcatgctaggtactagtgccacctgttcctgcaggcaagagagtcctctaatagtcaacagtccaccagagactcccaactgatctggccaaatgttcctagagctgtgtgttgtgtctcagactcctcctgcccaaccttcttccttcaccctctccccttcatcagctggcttactgttcacttcaaggtcaagacattggctgtctgatgcagggacatccctggcacggcctccatggtcatctagcaaggggagggtggagcaaaggcttggtcccatagcatatattcacccatctccttgtccatttgttgtcttccagcagaatgtaagctctgagaaggtaagcagtttcctctcctttcctacaactgctgtcttccttgtatctagcacagtggctggcacaggctaggtgctcagtaaatatctggtgaatgaacccaggtcccctgaattctctgcttcatttcacaaagctgatctgagcacctattaggtctacaagctgtggcaggtattggggataagatctgagcaagacaggacccttgccttcaaggcactgagttctcaaaggcaagatggtagctatacagctaggcacagaattgtgtgactacagactatggccacagagctcctccttgctgacagctggtgggagctggtgttggctttgtttactgagcatccctacaaagggatttggggcttatgtaatctgaactcaaccagaaggtcagagaaggcttcagaccaaagtttaagataaagaggctgaggcaaggctccagtcccagagcatccccaggaggcctaccctgttcttccatgaatgtctcttgattagaaactctagagtctaggaggtcaaggtgggaggaacacttgaagccaggagttcaagaccagcctggacaacaaagcaagacctcatctctataaaaaataaaaattaaaaataactaaaaataaaatgagagacagagagagagagagagagagagagagaggacagaccagcctaggcaacatggtgaaaccctgtctctacaaaacatacaaaaattagctgggtgtggtggtgtgcacctgtggtcccagctactcgggaggctgaggtgggagagtcacttgagcctgtgaggcagaggttgcagtgagcagggatcgtaccactgcactccaagtctaggtgacagagcaagaccctgtctcaaaagagagagagagagattgtgagaaacagcagagtctgactggagctgaattattgagctcagcctgggaccaactgtcccacccactgaccagcactgaggacagagggtaaaccctgcaaaggaacatttttcatcactccaagacctgatgttaaccacactgaggcttcacattacacagaacacaatgacaatgttctggttatgtttcttgaaaagagtttttttttttttagagatacacattaaaatatttacagatgaaatcatataatgtctgcacgttgcttcagaataatattacaggggagaagggataggctgattcaggccattagggcctggtgaaggtacccgagttctgtctatctttaggttaaaactttttcatcataaaaggtttcctgaaaaaagcaagaaaatgtaaaaatatatatatatagattacatgtggacttggagcagccaacaccattgcttcctgtccccaccagcagccaagactcctcaagctgaaatactggggtcggccacacctttgcaccacagcttcctttgttcttcctgaagtctttcctaattgtgctggaatgcaggcattgcagcagggaatcccctgttccaaagcctttgctggatttttttttttttgaggcggagtctcgctttgtcgcccaggctggagtgcagtggcgccatctcggctcactgcgagctccgcctcctgggttctcgccattctcctgcctcagcctcctgagtagctgggactacaggcgcccgccaccacgcccggctaatttttttgtatttttagtagagacggggttttaccgtgttagccaggatggtctcaatctcctgacctcgtgatccgcccaccttggcctcccaaagtgctgggattacaggcgtgagccaccgtgcccggccactggatcttataaatcacaggatttcagaggagatgcggccctggatcagatactaacatcttatgtcttcccttgagtgctgggaaaggggaggttggagactgggaaacattttgccatttgcagtcttaggagatctttgtaaagatttctccctctggctggttttgaccaggatattgccaaattccacgtcttggtttctggatcctcccgagcctttgagtttcccgtgaggccacagctgtagggaggctgagccaagtggccataacaaccaggcagagtagcaggaagaagcaggggcagggtacaagcctccccctcaggaggggaacttccctgtgccaaggggaatgaagggacccaggagatgcacagcagacccagtgccctacctctttttatagtccaggtcccccacagacccctttatcagctggcttactgttcactccaaggtcacgacagtggctgtctgatgcagggacagaaatccctggcacagcctccatgttgtccctctgcagagacaggaggactcaggcctggccatgatgctggagtcaccgtggatataggccctggcccatttgactcaagaacacatacataactggaaccaagaggctggcgaatcctctcaagaccctggccacttggaagaccctaagcctccttgcaggtggccatactaagcaaagtcacttgcagccacccttccacgatgcgttctacatcacccagctgtgaaaaccacccacccccatccccatccccttcacactcatgccttcctcctgagctcaaggggccctggcccaaggttcctttagaaccaggaaggaggttttgtccctctgaaaatcatccttttcaaacagaaggcatttatcttggccaggcttaaaagacaaaaagatgatagctgagctctagggcccatcccacagacaatatccagaaaccttctccccacaattcccacaccagcctcccagcagctggatcttttctccacgggatttgcctacaagacttctctccggctttatctcaggcgggtttgtcaggggagcaatgtcaccatccctccaccaaattcacctcaacaacatttactgagcaccaagtgtgtccccaccgtggctcagccttcccacgcactgtcctgatttaaccccacgtgcttataacccaagggagaatcactgcgatattttatcaatgtaaagacacacatcttaattgttcatattttcatgcacctgaaatttgggtaggtcttctaattacaactgtgacatggctgtcccgcctggtcccatacagactcagtcacagcagttcatagcattgtcactttaattaagttttgggcatggttgttacttcaaatgtggagtgtaggtgctattttaaatgtcttcaaaaagattcaactgtgattcagctttgaattgaaaagctattgtgcacacaggaagcctgggaacagagcagcagaatgcctgtgcgatgctggcgaggcagacacatattcatccctgcagacaggcccacaagtccagattttcttgcaaagcaccaaccaaatacttaaaaacttaaaatgggacttaaaaaccatcccaggctgggcacagtggctcacaactgtaattccacagctttgggaggccttcaggattactgaagcccaggagttggagaccagcctggacaacatggtgagacccccatctctacaaaaaaaaaaaaaaaaaagaaaaaaaagaaaaaacttaaaaattacctggacatggttgtatgtgtctgtagtcccagctactcaggaggctgcggtgggaggatcgtttgagcctgggagttccaggctgcagaaagctacgattgtgccattgcattccagcctgagcaccaatgagatcccatctcaaaaacaaaacaaaacatccccgggatgagtggacacacttgcaagaaatgcctcacttcctgtgcttctcgattaggggccaccaaatgtttcatgcaaagggtgatagggaatatttttggtttgtaagctacacaggctcagctgcaaccactcaactctgccatcagggcctgaaagcagtcatagggttgtaactatgctccaacaaaacttttttttttttttttttttgagacggagtctcgctttgtcacccaggctagagtgcagtggtgcgatctcggctcactgcaacctccgcctcctaggttcatgccattctcctgcctcagcctcccaagtagctgagactacaggtgcccaccaccgcaccaggttaatttttaaaatatttttggtagagacggggtttcactgtgttagctaggctggtcttgatctcctgacctcgtgatctgccggcctcagcctcccaaagtgctgggattacaggcatgagcctccgcgcccagccccaacaaaactttatttgcaaaaacaagtggaggaccacatttggttcatgggtggtagtttgctgtccctttctcttgatagaacagaaaacaatgtggaaaaatgagggcactgatgattttaagtcaaaagtgatacagaagatgaactttgaactaaaaaaaaagttttaagaatatcttacttcaatgatattttatctgtgtgtacttacaaaagtgatgtgtgattaaaaaaccaaacaaggggactgccatcagcaacagccccaaagcccactgggctccttggtgggttgtgagttcagcagcctcagcagggtgcatcagtcgagcacagctaggactccccacaacatgcgtgtcccaggctggcactgagacacagcgctgatgttgctgccgggggctgctgatggcactggtgctggtgctggggtggctgctatgggtgagggggcgtcaaggaagagcacagtagtgtgtagatgtgaaccagggtccccaggtggtcgcctttgaatgggccaatgtccaagacctgtacatgattgtgctctgcatccttgcagccagcctggccaagactggttctacctgtcccacaaggtcaccagcatagtccctgagagcaccctgctcatcatcctgggcctggtgctgggcagcatcatctgggtggccaaacacataacatccttcatgatgatgtccctcatcatgctagatgccagctacttcatccccaactggctcttcttcggcaacctgggcaccatcctgctgtacaaggtcatcagcaccatgtggaatgcatccaccaccatcctgtccctctatgacgtctctcttagtaggctcatgggctacctgcagatagggctgctggacttcctcctgttcggcagcctgatcaccactgtggacccagcagctgtcctggttgtgtttgaggaggttcatggcaatgaggtcctgttcatcatcatcttcagggagttgctactgaatgactctgtcatcatggttctgtacaatgtgtttcaatcttttgtgacactgggtggtgacaacgtgaccagcatgaactctgtggaaggtgtagtctccttccttgtggtgagcctggggggcatgctggtgggaatggtctttgcctttctgttgtcactggtgacccacctcaccaagcatgtgcacatcatcgagcctggtttcatgttggtcatctcctacctgtccattctgatgtctgagaagctgttgctgtaggccatcctggccatcatcttctgtggcatctgctgccataagtacatgaaggccaacatctcagagcagttggcccccaccatgtgctacaccatgaagatgctgaccagtggcaccaatcccatcttcatgtccctgggcaccttagccatgaacctgctcatctggacgtggaacaaggcattcatccgcctgcactggccttcatcttcaggtactgaggccatcagtgtcatccactcctggctcctggactgctattggatggtgtggctggaaatcataggccaggtggtcatgtcctgtggaggcctgcatggggccatggctttcatcctggtcatacttctgaatggaaacaaggtcaaggagaagaacctgtttgtcagcaccaccgtcaacatcttcaaggtcatcttctggggtctgaccatctagtccctggtgcagtggctgaaggtgaagaggagtgagcactgggagcctaagttccatgagaagctgcaatgccaccctctcgaccacatcctcttggccatcaaggacatatcgaggcatatcaggcacaatgatctcaaagacatgtggtcccactttgacaggaatttcctcagtggagtcctcatgagaaggctggcccagaagtctccagaagggatcctcaatgtcttccatgcactgaacctgaaggatgccatcagctaagtgaccaaaggagagtgcctgagatccctggccttcatcggctccccaagtactgataacgtggtaaacgtggacttcacaccacgatcgtccaccatggtggcctctgtctcctaccacctgagggagaacatcagcaccgtctgtctagacattcagtccctggagcagcatggcagagcattcggtacggggaggacacggtcatgcaccacatgctgcagcaatacctgtgcaagctggggaaggagtatatgcatcgctacagccacaccagctgaggacaagaagcaggaccgagatatcttccacaggtctatgaggaagcacctggaatccttcaagtagaccaagctcaggatcacccagaacaagaaggcggccaagctgtacaagccaaagcgtgcccagaaacagagaactcccaaagctctgtacccgctccagcacagctgcactaatgccaacccaggccagggcctgggcctgagcggccatcctacactgctgaacaaaatgaatttgcaaaagtgataccccaggcaaggctccaggcccctcccagcccagcatctctccccagcacggtggggtgcatccagagtgccaggactcagggcctgaccctggagtggctgcaggcccagcaagtggcccaggctcaagtgctattttcaggtccttagcagtttgttgaactgctgggtcacctcgtgcgctgcaggtaaagttgcaggaatgtcttctgtttgctcagcacttgcgatttagactccttgaaccagcacctgccccctttccctcccagttaccatcctgcccttgccagctttggaggtggaagctctgggtggctgccatgcaaatgcctcttctggatctggtatcgcaaggggggatagagggatgaggcctgaggtgaccttgaggtcatttaaattttctaaattagacaaaacaattaaaaaaaaaccatattcccatgccttttaaaaatcaaaaccacgtactgtttcttttcagtgtaagcagttttaattacctaccaggtgcagagtctaggatacaagacagaactgcagataaagtctctttccagcatagctaggagacatggctcactccacctgttcccaggcctcacctagaaatctaatgaatggctccaaaccaggtaaactagataattttccaaagtcaaagaagcagtttatgacattaaagcacttagccaatttaacctctgacttaatttagaacaaatgtctaaattttaaagacttttttaccaataattttaaaactgtatttcccaaagattactgaagtcatgtgaaataaaaggcatgagagtgtctattcttctgacaacatatttaagaggtttcattttctcttaatccaattaattagagtaccttcatataagcatcacacacacaacacttctagacaggagaagatctagcagttgtaagtttttctttcccatcttatgactttctgacttgtcctatattttgctctttcctagtcattctactttaggacaagaatttgccatacaagatgctctctcacataaaatttctttccttcataacctatcttacataaatatatcttcatatccacaactttttcttttcttcttttttttttttttttttttggagatggggttttgctcttgttgcccaggctggagtgcaatggtgtgatctgtgctcaccacaacctctgcctcccgggttcaagcaattctcctgccgcagcctcccaagtagctgggattacaggcatgtgccacaacacctggctaattttctatttttagtagagacggggtttctccatgttggacaggctggtctcgaactcctgacctcaggtgatccgcctgcctcggcctcccaaagtgctggaattacaggcatgagccaccatgcccagtttccacaactttttttagatctctctcccctactaatttctgatgcccacccaaatcaaaaaggtcagataaagcaaggcaaaacagagtagagccttagattttgagagggacctgtctgcttacacttcttgaagttccataaggaaaacagacgtttctcctaaaatggagtctatggcaccttctgtttttcctaaggagtcccaggttgtcaggaattaccttaggtcctctcatatgagcatcaagagtggcaagaagacagactagggaaataattcagtcaactgagaagaaaaagaaaaccttagtactgttccccttgtaaagatggataaatggaggcaccatgcatactgtacggaacccgcccaggcaatgcaacctgggatagcatgcccaacgtgcccccgtggagagcagtgcagacccagataccacacctaccctgcttccttttctaccactctggccatactcccactgtgggctgccctcctaccgctctccccgctgcagtctccatggccaccaccaacctcagctaagcgaaacacgttgccacacgctcaagcctaccgcatccagcaggcgtcttacccttctccttctctaagctgggcaccgaacatcagggtatgcagacacaggagagcccggtaatggcctgattccttgccccctcagccggctttatatagggaggttttgcaactgagtgcctggactacatattctgattggatgagagaaaacgtctaggcctactctgattggactttattgtcatgttctgattggttgccttaagaattgctctcatccaatcagaacatgataataaagtccaatcagagtaggcctagaggtttttctcccatccaatcagaacatgtagttcaggacccagtggtgtaacttccctatataaagtatgctgaggggacgtcaggccattgcagattctttagtgtttgcctcctcagcggctcttgcccggcttagaggaggaagaggcgaaaggaaagacacctccctcactctggcctaaggcaccacggctcacctcactgctgtggttggtggttgctgccacggagactgaagagccaccggagtagtaggagggtggcccacagtgcaggagctgctcagtgcccggcttaaaggaggaagagaaggggaagacccctgtcccaagctggaggctggagctcttggcacctcggctggcctctctgcgattggtggctgtaatgaagactgcagccccgcctgagcattaagaaggagaaaatagtttttgggtaaatggagggagaaaagagagtggcaggtggaaggagtacagagagagtagtaaaggggggaaaacacgggggcgagcaagagggagaggaagttttgcgaaaagagagtggggagaaaagtttttgggtagatagaaggggaaaagagggtggcaagcaggagccataaaagatggtggggaaaagagtgggggaaaagtttttgggtagatggagggggaaaagagggtgacaagcaggaggggggaaggagggttgggaaaacgacggaaaaatagttttggggggcagatggagggtgaaaagagggtggcgtgtgggagaggggcgggagtggggaaaagaggttgttgagcaggagcggggagaaggctttgtgaaaagatggtgaggggggaaagacaagaaaaaggtttttgggtagatggagggggaaaagagggtggtgagtaggagggggcaagagtggtgagcgagggagacaaggttttccaaaaagaccatggaggaaaatgtttttgggtagatggagggggaaaagagggtgacaagcgggagaaggaaaaggggtggtgagagggagggagagaaggttctgcgaaaagaaggaagacagaaaagaaagatggtgcagaaacaaaaaacgtgggtaaaaagcttttgggcagatggaggggaaaaagtggcaagtgggaggagaagagagggtggcgagagggaggtagggaagaggattgggaaaaagatgatggggaaaatagttttggggtagatggagggcaaaaagagggtggcaagcaggctaggggaaagaagagggcgagcgggaaggaggaagggctttgtgaaaagacagtggggaaaaatttggggggtagatggaggggggaagagggtggcgagccgaagtggggagaaggctttatgaaaagacagtggggaaacgtttttggatagatggaaaagagcgtagcaaggaggggaaaaaagacgatggggaaacagtttttgggtagatggagggggcaaagagggtggtgagtagcaggagtaggaaaaaggctttgggaaaagatggagggaaatgtttttgggatgatggaggagcaaaaggctaatgagagcggaagggggaaaaagagggtgggtaaaaactgtggggaagtttttgggtagatggggaaaagagtggtgagtgggagagtagagaaggtgttgtgaaaagacggtggggaaaaaatgatggggaagaagttttggggtagatggaggaagaaaaaggatggcgagagggaggggtccgaaggcggtcaggaaaagaaggcagggaaataatgatgggggagaaagcttttgggtagatctttttctgatttttaaatcagattatttgcatttttgtttttgagtagttcttgtcttctttatatattttgtgtattaacccctcgcctgatgcatagtttgcaaatacttccattctctggattatttcttcattctatggattgcatcctctgctttgcagaagttttgaagtttaatgtaattccatttgtctatttttgctttttctgcttgtgcttttgatgtctatttgaaaattccttgtcctaaccaatttcctaaagtatttttcctatgtttttttctctagtagtttcatagtttcagatcctatatttaaatctttattttgagttgattttcttacatggtaagataacagtctagatttattcttctacctgtgggtgttgggttttcctagcacagtttattgaagagattgtccttcctgaatgtgtgttcttggtgcctttgttaaaattgagttgactgtaaatgtgtgaatttatttctcagttctctattctgtttcatttgtctatgtgtgtctgtctgtcatttgtctatgtctgtctctctgtctctccccgccccccccccttttcttgccagtaccatgctgttttggttactatagatttgtagtatattttgaaatcagtgtgatgcctccagcttttttctttttattcaacattcttttgtttatctgaagatattttgcatttccatgtgaattttaggctggtttttttttgtatttctatgaagaacatcttttgtaatttaacatggattgcactgactctgtaagtcatatattgggtgacacagatattttaacaatattctttctagtgcatggacataggatagctttctatttacttgcatttgctttaatatctttcatcaatgtgttttatagttttcattgtgggatcttttgcctttttggttaagtttatccctaggtatctttttttggtgagtactgttaatgaaatagctttcctgatttttcttaggtgtttcactattggctcattggtgcgctactcatttttgtatattgatattgtgtcttgcaattatactaaatttattatttctagtaaaatttttagtggaatctttagggttctctattatatgatcatgttacctgaagacagagaaaatttgactcctttttttccagtttggatgccttttattcatttgtctaattgcattctcttgcctaattgctgtagtgaggacttccagtactataatgaacaaaagtggtaaaagtagccacgtttgttccagattttagaggaagagcttttaaattttccccattgattatgatgttagcagtgggtttgtcatatatggcctttattgtgctaagtaatgtttcttttgtattcattttgttgagtttttatcatgaaagaatgttgaattttatttttttcagcatctactgaaacgattacatggtttttgttgttgatttgctgaatatgatgtatcacatttatttgtttattgaatcatcctcattttcctcagatgaatcttgcttgatcatggcagattatctttttattgtattgtcaaatgcaattttcaagtattttgttgaggatttttttgcatctgtgttcatcagggatatttgtctgtggttttctttttgtgttgtgtcctggtctagtttttgtaccagggtaatgctcgccttatagaacaagtttgaaagtattcctcttcatattttggggaatattttgagtaaaatcggtattcgttgttttaaaaatgtttggcagaattcagcaataaaaccatgattcgtgtgtttttcttcaattgacaggagactttttattactgctttaattgcattactcattattcgtctcttcaggttttttatttctttatcattctatcttgggaatttgttatatgtccagaaatttattcatttctcctacatttttcaatttgtatataagtgtttttagtaatctcttagaatactttgtatttctgtgtgatcaactgtaatgtctcctttttcgtctatcattttcagtttttcttagtctagttaaagcttgtcaattttgacttttttccaaaaacaaaaaaaccccagcttttggttccgtttgactttttgtattttttttagtttcaatttttaatttttttctaatctttattattttatttctactaatttgatttttcttgtttttctcattacttggtgtattgtcaggttgggtatttgagatctttctacttttatactgctgtgttgacttctttacccttatataattatctttctagtttttctttttttgacttaaagtctattttatcagatataagtgtagctactcctgcttttttgtttccatttgtatgggatatcttttatcatcctttcattttcagtctatgtatgtctttataggtgaagtgagtgtcttagtcagtatatagttgggtcttgtctttaaatccactcagccactttgtcttaattggagaatttaattcatttatattcaagattattactaacaggtaaaaacatactgttgccattttttacttgttttctagttgttttgctactctctttttttgttttctcctttcctttctcttctctcctctctctctcctttcttcctttcttttccttcctctttcccttccttcctgtctttatttgtagtgaggtcattttctctggtagtgtgttttaatttcttgcttttttatttttagggtgtctattactgatttttgttttctggtcagcatgaggctaaacaacataattataacgagttattttaaactgaagaaaacttaaccttgattgcaaagaacaaaaaagagagaaacaaaaaaaactaaaaacatttaccctgtaactctatcccccgcaacacacacacattttgtatttagatgtctttcagtatttttttttttttttttttttttttttgagacggagtctcgctctttggcccaggccggagtgcagtggcgctatcttggctcaccgcacgctccgcctcccaggttcacaccattctcagcctcccgagtagctgggactacaggcgccagccaacgcgcctggctaattttttgtatttttagtagagatggggtttcaccatgttagccaggatggtctcgatctcctgaccttgtgatccgcccgccttggcctcccaaagtgctgggattacaggctcagtatgtttctatattgcctatccctttaaaaattgttgggttatattattattttaacaattttgtattttagccttcacatgaaagatataggttgcttatacatcacaactatagtattctaaatttatctgtgtacttttagtaatgagatttataccttcagatggtttcttgttacatgttagcatcattttctttcagactgaacaactccctttagcatttcttgtaaaccaggtttggtagtgatgcatttcctcagcttttgtctgggaaaagtatttatctcttcttcatttttgaaggatctattctttgggtgtggtttttttcattggtattgtttttcttaagcactttgaatatgtcatcccacttctcccataggagggaggccctcagcctgtttaatttttgctgagaactctgcttcctgacatatcaaaggtcctcaatatgttgtttgattcacttctcttgctgtttatagtatcctctttgtccttgacatttggagttggattattatatgccttggcatagtttttttttttttttccttgagatggagtctcgctcttgttgcccaggctggagtacagtggcacagtcttggctcactgcaacctctgcctcctgggttcaagcaatcctcttgctcagcctcccaagtagctaggattataggcacccacgaccatacttggctaatttttgtatttttagtagagatggggttgcaccatgttggccagggtggtctcgaactcctgacctcaagtgattcacctgcctcggcctcccaaagtacttgggattacaggcctgagccaccgcacctggccactttggcgtagtcttatttggcttgaatctgcttgatgatctttggtcttcatgtacctggatatttatatatttctcttgaattggaaagctttctgttaccatctttttgaataagctttctactctttctctgctttctcttgaagaccaatgactcttaaatttgctcttctgatactatcccatagatttcctaagctgccttcattcttttttttcttttcttttttctcctattgtgtatttcaaatggcctgtgtgagctcactgattctttctctgttggatcagttctgctgttgaggccctctcatgcatttttcagtgcatccattatatttttcagctttgaggtttttgtggtcttttaaaattatttcaatctctttgttaaatttctttgatacatttccgaattacttatatttttaaaattgcattgattttcctcaaaacagctattttttacctccctctctgaatagtttaacatctttatctctcctaggttagtcactggtgacttgtttattgtttggtgaggtcatacttccctgaatgttcttaatgcatttgggcctatgttcatgcctgggaattgaataagtcagtatttattccagtctttgtagtctggtcttgtttgtacctgtcctcctctagatggtcttccagaaattccaagggtactgactattgagttccctaaggctggggtcactgaagctgtttcagcaccagggtgccctaagctcaggttcactgtgactcttgcaggactgaggtcccagagggccctgatggacttggagaagataagggaggggttccctgggttcccaggcaaagtgcttcattcacttccctcttcttcccattggaaggagtctgggtactaagctttgtggatctgggagaagggtggcttgggcactcccatggccactgcagctggcaccacatacccgaagcccacagcctctaggaccagagcagcactggggcttgtctgagtcctgtggccactactgcctgactgctgctgacttatgtaggtcttgaggccgagctactctgctggtggtgaagctggccagggtttaggtccatcccgccagggcagcaggttctcttctacctccaggcaggtctagaggtgtctgggagctcctgcctgggatcagggccactgtgttctgcctgatgctgtgtccaccgtggtggagcctggactgggttctcctctttcctgcataggaaaggagttctcccggcactgcactgcctggagttgggattagggtaacacaggcagccctgtggccactgtagcggatgtcatatatgaaacccacagcctcccagaccagcacatcattggttgctggggctcacccaaggaccacagtggctatggcctgcctgccactgaaatttattcagagcctgaggccactttaaacagctggtggtgaaggaagtcaggactcaggtttgtcccaccgggcagtggattcccttctagcccaggtcatgtctaaatgctctgtctgtgggcaccggccatggaatcaaggaccatggggttctgcccagtgctgtgttttactgtagcagagctggtactgggctccaaggcaaagtttaatgcacactctcttctccctcctggaagtggacacattgtctctctgcactgcctggggttgagggagggatggtataggcactgcaagactgtcttttccaccctgtttaatgtgtcttttcttgtttttaagctaaaaccaggttctgtgatctgtcacctgatttctttggctcttgtgaaggtattctcttgcttagattgttggtggttcaatttgatgttcctgcagggagacaatcttgtagagttctattctgccatctcgctccaccacttctcatttatttaattgttcttcaacttatttcaacaatattttgcaggtttcaaagtatgaattttgcactgctcttgttaatttctaaatttattacttgttttgttggtattatacatgggtttgtttccttaataccattttaaagcagtttattgatagtatatagaaataaaattaaatttttagtattgcatttatatcttgaaactacgtcaaatttatttctaatagtattttactgaatttcttagaattatatatgagatcgtgccatgtgtaaatataaaaaaattattttcttttcaataaggatgttttaaattttccgttctttactacacctcgctacaatctacaatataatgttgaatagaatttgcaagagtggacattcttgtaactgattagtcattcaccctctcattgctgagtataatgatagctgtaagtttcataggtaactaccactagtttcaggaagttaccttattgttcgtaaatttggagtgttttgttttttttttgttgtttttttttttttttggagacagagtttcactctttttgcccaggctggagtggtacaatggcgaggtcttggctcactgcaacctccgcctcccaggttcaagcgattctcctgcctcagcctcccaagtagctgggattacaggcgcctgccaccatgtctggctgagtttttgtatttttagtagagacggggtttcaccatgttggctaggatggtctcagtctcttgacctcgtgattgcgcccgcctcagcctcccaaagtgctgggattacagttgtgagccaccgctcccagcctggagtgtttttattattagaatgtgtgatattttctcaaatgctttctgtctgagatgcttatatatttttgtcttttattctgttaatatggtgtttgcatgcaatgattttcaaatattaaatcaatggtgcattcctggggtaaatcacatctgcgtatagtgcataatctattttatatgtttctggattcagtttggcaatattttgttgaagacttttgattttataaaacaatgtgctgggcgtggcggctcacgcctgtataatcccagcactttgggaggcctaggtgggtagatcacctgaggtcaggagttcgagaccagcctggccaacatggtgaaaccctgtctctactaaaaatacaaaaattagccatgcatggtggtgcacgcctgtaatcccagctacttgggaggctgaggcaggagaatcgcttgaacctggaaggtagaggtcgcagtgggttgagattgcaccactacactccagcctggatgacagagtgagactctgtcacacacacacaaaatgaaagatactgttctatattgttttgtgatacagttttggtgtcagtaatcctggctttataaaatgaattgggaagtgttctctccccttttattttctgcaagagttggtgaacaattgatattaatttctcagtgtgtttgatagattttgcctgggaagctacttgagatttttattgtaagtttttaaaattacaatccaatctttttaccttctgtagatctatttcgattttctatttctccttagtcctttcatctattttagtttgtgtctttctaggaattcatccattctatctaggctatctgatttttttaacataagattttcactgcattgtcttgtatttttattttgtaatactggcagtgatgggttttcttttattgctgattttagtaatttgagtctcttctctctttttcttgattgacctaagtaaacatttgccaattttgttatcttttcaaacatttaattttggtttattgattttctctgttgtttcatattccctttctgttggcttaactcttattatgaaattttttttgtctttaaaaattttatatttggttaattaaaatttaagttgattttggggtatcaacgcttctcttatatgaaaataagagcatgaatcaagaaataatgggttcccaaatactgcagtggaaacacatttttttgggggggtacaaaacaagtatccatgtacatatagtccttggttccccaagtcattgagtcaacttagtcaaaataagtagcctctcatttcttatctcatgagggtggtcttgccttgcttggagacattataatgaattcacttgatgtagttacttttaagcataccagtttacttcatatcccattttcaaccagttatcgtacccggaataattgctagaatcaaattccatcatgcacaggtaaataagtaaattctgtcatttactatctaaattagatatataattatttatagatacgtacatatattttacttgtaattcagtgaacataaggctttgtatgctctgtctaaaatatgctgtctatattaattctcatgatagtaaagaatagagtgatggagtctatattttacatatatcttccatttagtagcagaaataaaatccttgtacttgatttggtaaattcctccatttaaattaagatgttacttcccggaaacaaaatttttttttcttttttttttttaaattttaaatctttaatttctgttttcacatattttctttttgcttccaaaaggaaaggagtgcgtagctctgttgactgtgtacatcgtccacagcccctgggtcggggcagggtcccctaggccgcccgggggtccacatgcagcccctggggggccggcgcggggtgaggtccgggggccgccttattgctgaggtccggccggttggggcccgccgctaggcgcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgtgagaagtcgatcacctcgtcctccatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgacgcgggcgcacccttcccaccagcgggcgtccccgggcccagctccggatgcgaccctccagtctccccactcagctaagtcagtgggtcagacccaggctccacaccagtcccgagggccacccccagcccccaacaccgcggcggtgggcgaagccagcggccccgccctattccctggcgctgccgttcactggcgtttcctagcaaggatctgcagggatcccgcctacagagtgcccctggggcaggggtaggggaggccctggcacctctcctcctcctggtcacccctaggtgcacactgggaactgtgtgccccctacattctgaatgcttcacgcctccctgcccgggttagaaagccgttcctggtgcactggccaggacagcagacactcttcctccctgcagcctttgcccacccccttggccatgaggaattcaggcagctgtgtccccaaatgtctccacccgattttggagtctcggagtccccacgcccaatgagatgccagtgcaacccaggtcagcatcgagggtggtggctgcggaggtggcaccccctcccaccagcaccttcccttgggagtggacaagtcctcggccacctcagcaccaccagctcccacccaggggcacccccacccccaggtcactggtgtgcggcccctgacccagctgatccagcaacagttacaaggcctcctcgtgcccaatcccaaccacgcgggacccacctgccaccctgcccatgccgggaccccacaactctcctcccacacgctccaggctctgatcccaggcagacgccctcttgcaaggcaggagcatgggcaggtgtgcatcccctctgcctggcattcggactccaccagcgggctgtccccgtccctggcctggaatcccagcctcctggcagcactccacagctcgccactcacccatgccccaaaggatgctgcctggctggtgcctgtggccccagctctgcctcggcctccccggcctgctccctggcagccatggtcagtagtgtgctgagccagcccagccctaccacctgctacagtcaggagcccccagctgccacctggatgtcaccactcaaaggaacgggacacatccccagtggaggccctgggcatgctctggcctccccctcacagctctgggcctaggttcctgcaggacaaagtggcagcaggacagatggccgagcagacagagctcagagctggccatggcgggtgtgactctgccagaggcccaggcagtagagacaggaggggccgaggaagtcgcatgaagtggtgattggtgtcagcgccccacactgctgggaggcccccggagccagggtggtgccaggggaccagctcccaggcccacagcagggaccgcctgcaatatcaccaaggcaacgaggaccccacctccccagggcctctgacttctcagagttgtgcctggtcccctgcgggagcaggtcagaccagtgggctggggagggccaggacgagacagccccagtggatggcgagcaggaaaggccaccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgcctccgcagatgggctcccagccacacgtgcacagacccccagaccaccacccactcccgactgccgggtggcatccacgcccctgtgataagctcagccccttcccgtcctcaggccaggggttcccagggagcctggctccacaggccagggtgtgggaggaccgcctggccacacctcagccatgtggaggcggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgcgcagggcctgccaggcggcgtcgatgtcggcatagaggttccactcggaaggcctgcccgcgctggcaccgtagccggagtagtcgtagatgatgttgcagtggaggcgggagttcagcccagtatagaagctgctcatctggcccaggtccaccgcgttgccgtgcgagaagaagaccgtgtacctggcaccaggcacgcagcgaacatacatgcaggagacgcggttgccgtgggcgctcttagtggggaagacctcgatggtgtccagctcgcgctggctgtactggaagtcggcgagctccgtcaggtgcagcttccagcgcccgaggaggcccgcagggtccccaagggggcggccccggccccaccaggccccggccccaccaggcccgggctcaggcaccagggagtaggtggcctccggcggcaggaaggcgagcttggcagcgatgcggccggggcagggcgggtagcagaaaaggcagcagagctcactcagcgacagcccgttcatggcaggcgcctcccgggccgggcctccaccggggcccccgccaacaacgccgcccggcctggccgggcaggggaggggtgggggtgctccgagtcgcgggcaggggtgagagccccagacggcagccccattaggaggccagggcccagccccatcgcggtccaagccgccccagggagcctcgcaaccacaggtctccatgtcgtgccgtgggaaggccaccccggcccgcgcccccgggccccagggccgcgctccatggctcccgaccgcccgcccgtgcatccgtcggtccctccgcgccccggcccggcctcctgcaccgccaccgccgcagctcccccacgaacggaagcaaaatttttcttaacgggatgataattcactagtttacctctaatgagtctcagtatttaatctatcatgaaattacgcggcaccaaaataaaatataattagttaaaacacaaaaattattttattgattaatttagacatcagatgtttacattatgaaatcaaggtattttttggtttttgttttgtttttagaatattagcaaatattaccaaacatgaaccatagtaaaagttcttcagtaacactttaccattccgttttcaaataacctgaatttatgtgccagattgaaaagcttttacatgagtgacctatatttctgtatgtatccaaatatttgtatatcatgtagacaagccaagaaaatacacagatatgtaagccattgcatagaatggtaaagaatacattcttaataagatgcattcgcttaatgctccaaacaggtctctagtatctcaaatgcagcattcacccactatttccaaacatatcagggccaggtgccatggctcatgcccataatcttggcactttgggaagttgaggtgggtggatcacttgaggccaagttccagaccagcctggccaacacggcaaaaccctgtctttactaaaactacaaaaaaaataaaaatagctagccatggtggcacactactataatcccagctactcaggagactgagatacaagaatcatgtgaacacgagaggcaggggatgcagtgagctgagccgagatcacgccactgcactccagcctgggcaacggagcgagtgagactctgtttcaaaaaaacaaaaccaaaagcattgtatcatgatatgtgactaagctgaatttaaaacactgtaacataaactagatgaaaagtattatacaaaatttttctttgtatttctatttgttttgaatttaccaacaattcaaatcttgctgagaatatttgcactataaatatttctgtgattattggttatattcaaattcgctcattttcaaagctacctgtataaaattattaaaattgtacatagcttggaataagagtatgttgaatataattgccatgtgatacatttatatttaataattaaaggcatattacaacacttacgcctcatcttaatgttacttaaccttagaaacagagtaaatgataggaataatatgggagacaaactgtggaaagccacattctgtatatctctgttgtttttattaaacttttttcctactgcactttaaatttgtcatagaccattattttagtaattattaatgtaatcttacgtatgtatattctctaccatcttagcaggttgaataaaatacatgattaaaggcaaaaatgtgtgcaaggaaaatatagaatatttaagttacaaaaagctactcttactgaatctcttaaattacagcttatagctaaagagtacaaactattgtaaaagttttctcccatttgtaagtaattacacatataaagtatctccccattcagtagatcttatatttctttgagaaacatatattaaatataaaatattctgaattctaaattgcatttaaaattgttcatcattggttatattatgtaattataagcaagtacatttaatgactacatactgtaaactttctttaccacgtggcacaaatagttaatttaccttttttttctgtctctgtcttctatgtcctaggctatttcagttttctcacgagtagccattattttcaatgaactaccaaaaagttataaggcagccacgatcaaacaaaaatgttagtaatatagtatagtataaaggttttttatttcttaatttatattccaaattgttaaataattttatcatccagtcttgatgtctgaaaacatcttaaaatagagaagttcacagtattagatgctgtatctttcttcatctaatgacaaaagactttagttcttttctcaattttaggagaagttttgctttaagaccaataaaaacataagtttacataagctgagagcacgttatgtatagctactctgtggaaaacattttattttaagagctattaggaacatcttttgagaatattcaagctatatatgatgctgcaaatttatttttatggttgctataactggcaaggcaagcagatgatatgcttgaagctatctcgtgatgagcacatctgagggaataaagaagggccttcacaagaagagggaggcagctggtacattcagtaatgcatcatgaacaccaatgcagtggctcctgagaaagagtcaatataatacctggattccttgtttctatctcatatgtaatccagtttcagggaagtataaaagtgacagggatggggagagtatatgaaccattaatatgaaatctaaagaagtgcaggcatccagctgtctggtgtctactgaggtcgttcacccagattaacaatacagatacttagttaaattctgaactgcagataatgggaaagtaggattgtggaaatcggctccatccaaattattactcaggtctcctcctcttccagatgctgtccccacagtatactcaaggtgtctgatgacagtgatgagcaactgaggaatcatttaattaccaagttcttcatccttacttaaaaatgtagagtcacaaaatcatatatgaaaacacactctttttttttttttttttgagatggagtctctgttaccaggctggagatactctttttcaatagagtatggccttctgtccactctcctcttattctttccagagtagcaaggtgtccttacggcatacatttagcataaaattagatgggttccattataaaataaaatggagacagaataagtcaatactgaattctttggtaaatcaagcaaagtctttaaaaatttttctagaaaatggatttatttttgtttttatttagtgtttgttttatttagttatttttagtttttttgtttgcttttgcttcattgttctgcattgctaactcgttaaaatcacaagctatcttattgtatattgagtgtatttgcaagagctgtttagtgttttcttccctagtgaaccaacataacgattattctgctatgagtctatgttacgaaatatgtctatgtcctgctattctcaggcttcatttttgcctctaaatccttcaggtactgttgttttgggcagtgtaatggatgtttcttcttttgttctttctgtgccttgaaaatttcagtaaggaaataaactggttgtcaaaaacacctgtttgttaaaattggaatcagactttttaaagaagagatatacttggtttccttggctaaatattcaaaagttaataggatttttttcatagtataacatagtttcaaaagttaaacgtaattgtatttagttttattgaatacctacttgtgtggcatattacatttatttttgttaatattaaatttaaacaattttaagtataaattattatatagtgtgcaaatgtctttttcatataatgacttctttttctctgggtatatacccagtggtgggattgtggatgaaatctatttatagatctttaaggaatctccatactgttttccatagtggttgtactagtttacattcccaccagcagtgtaaaaatgttccctttacaccatattcatgccaacatctgttgtttttttattttcttaattgtggctattcttgcaggagtaaggtggcatctcattgtggttttgatatgcatttccctgataattagtaatgttgagcatgttttcatttgtttcttggccatttgtgtatcttcttttcagaattgcctagtcataccctttgcccactttttgatgggatttgtttattcttgctgatttgtttgagttccatgtagattctggatattagtcctttgtcagatgaatagtatgcaaaatattttctcctaatctgtgggttgtctgtttactctgctgattatttctttttctgtgaagaggctttctagcttaatttggtcctagctacttatctttgtttttgttccatttgcttttgagttcttattcatgaagtctttgcctaagccaatgtctagaagagcttttctaatgttatattctagaagttttatggtttcagggcttagatttaagtctttcatccatcttgagttgatttttgtaaaaagtgagagatgaggatccagcttttttcttctacatgtggtttgcaaattatcctagcaccatttgttgaatagaatgtcctttccccactttgtatttgctctgtcaaaggtcagttgactgtaagtatttggttttatttctggttctctattctgttccatttgtctatgtgcctatttttataccagtaccatgctgttttggtaactctagccttgtagtatagtttgaagttgggtaatgtaatgcctctagattttttttttttttttttttgcttagttttactttggctttgagggcttttttttggttccatatgaattttagggttgttttttctagttctgtgaagagtaatgatggtattttgatgagaattgcattaaatttgtaggttgctttagtcagtatggtcattttcacaatattgattctactcatcgatgagcatgggaggtgtttgcacttgtttgtgttgtgtataatctctttcagcagtgtcccttagttttccttttagagatctttcatctccttggttaggtatacattcctaagtattttattttttgcagttgttgtaaaagaggttgagttcttgatttgattctcagcttggtcattggaggtgtataacagtgctacctctgatttgtgtacattgattttgtatcctgaaacttggctgaattcatgtattagatctaagaactttttggatgagtccttagggttttctaggtatacaatcatatcatcagtgaacagcagcagtttgacttcctctttacctatttgaatgccctttgtttctcttgtctgattgctctggctaaaatttccagtacaatgttgaatagaagaggtgaaagtggatatccttttcttgttccagttcttaggcgaaatgctgtagatttttctctgtttagtataatgttgactatggatttttcatagatggcttttattaccttgaggtatgtcccttctatgctttttctgatggttttaatcataaatggatgctggattttgtgaaatgggtttttttgcatcaattgaaatcatatttttaaatttttaattatttatatgtgattaattacatttattgacttgcatatgttaaaccatcccttcatccctgatatgaaacccacgtgatcatggtgtattatctttttgatataatgttggactcagctagtattttgttgaagatttttgcatctatgttcatcaggggctgaactatagacctacagagtctgaactattggtctatagttttctttttttgttatgttctttcctggttttggtattagggtgttactggcctcatagaatgatttaaggaggatttcctctttctttatcttttgaaatcatttcagtaagattggtaccaattcttcgaatgcctgatagaattcagctgttaatccatttggtcctggacatttttattgttggcaattttttttactattgtttcagtctcactgcttgttacttgtctgttcagtttctttctcttttttttttccacgtaggatctcgctctgtcgcccaggctggagtgcagtggcacaatctgagctcactgcaacctctgcctcccaggctcaagtgattctcttgcctcagcctcctgagtagatgggattacaggtgtgcaccaccacacccagctaattttttttattttcagtagagacagggttttaactctgttggccaggctggtctcaaactcctggcctcaagtgatctgcccacctcagtctcctaaagtgctgggattacaggtgtgagccactatacccagtgcagtttctatttatttgtgttttaatctaggagggttgtatatttccaggaatttatcactctctctaaattttctagtctgtgcacataagggtgttcatagtagccttgaatatatttcatatttctgtggtattggttgtaatatttcccatttcatttctaattgagcttatttggatcttctccctttttttcttagttaatctcactaatggtctattgattttgtttatctcttaaaagaatcagttttttgtttcatatatcttttgtatttttgtttcaattttatttaattctgatctttattatttcttttttcttctgggtttgggtttggttggttcttgtttctccagttctgtgaggtatgactttagattgtctattcatgctctttgatgtaggcatttaatgctatgaaccttcctcttaattttgctgtatcccagaggttttaataggctttgtcactattatccttcagttcaaacaattttttaaatgttgcataacaatgtttatttagttttacatttgtttacaatttcttataaacacttttcgttataattttatacaaacaacagtaggagaaacaaggagctagaaaacattagaaagttgagatttggagggaagaattttaaagactggaagtactagagggagagaatctagagaatgaaggaggcaatacttgaagagataacacaatgttccaaatttgttggtaaaacatgaattcgtaaattcaggaaacacaatatataccaaacatatatttaaataaaatccaggcctagactcaaggtagtagtaaatgacaagataccaaacacaagattttaaaagcaaccatggggagaaaaagatcatcaatgaaggcaagacagtcaaatcgtaggcttcgtaacagcaacagtgtacccaaacaattattttatttatttatttattttttgagatggagtctcgctgtgtcgcccaggctggagtgcagtggcgcaatcttggctcactgcaagatccgcctcccaggttcacgccattctcctgcctcagcctcccacctagctgggactacaggcacccgccaccacacctggctaatttttttttgtatttttggtagagacggggtttcatcgtgttagccaggatggtctcgatctcctgacctcgtgatccgcccgcctcggcctcccaaagtgctgggattatgggcgtgagccaccgcgcctggccatatttatacttttttaataccactaggctcaacccgtatgatattttttgcagcagctttcttgagatgtaattcacataccgcataaatcgcccatttaaaatgtacaaccgagcggtttttagcgtattcatagagtcgcacatcaccacaatcaattttagaacatttttatcaccccccaaagaaatccacatcctttagccgtcaacctccaatccttccatttctctgcacctaggcaatgtataatctactttctgtctgtatagatttgggtactccggatgtttcacgtaaatgcagtcatgcgacacgtgatcttgtggctggcttctttcacttagcgccatgttttctagtttcacccgttttcagcatgtgtccgtccttttccttcttttcaaaacagttttattgagatgccattcacataccatgcagttcattcatgtaaagcatctgtaattcaattgcctttagaatatgcacagttacgtagccatcaccacaatacattttagaacattggtatcacctcaaattcctttttattgccaaataatattccactgtatggatataccacgttgcatttatccactggtgggcattttcactcttagaatattataaataatgttgctatggatattcgtgcacgagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttttttgagacagagttttgctcttgttgcccaggctagagtgcaatggtgagaactgcagcctccacctccaggattcaagtaattctcctgcctcagcctcttgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcgtccggccccatgagcatctttaggcatcaatcttttatgcatctctggttatttctctagagcacattagtcaaatgattgtatcaaagggcacaggcagttttgaggctctcagtgcatgatgatatattgctttccaaaaaggctgtgcccgtttgcattctcaaaagtagagtgtgcacccctccttatattttaatagtttcctgaggtcatcagaacatgaacatggggagggcagggacttgcttgggcatcttggataccatgcccagttgaatgtgcagtacttagtaggggtttgtgtgacaggaatgagtgagagcacatgaaggcccagatgagtgcagggtccgtggggcacagaggagggtacaggtgtgtgagcaccgtgtggacttagcacacggctgacgtgaggactcagtgcagacacaagtggtaacaaggcctcgtgaatcaaagagctcctcaacctggaggtcgaagcagctgattggagatgaggaagccacactccaaggtcacttagggacagacgctggcagggctgatctgaagactggcagcaactcctttttatactccactctgcaagcgccagtctttatgcagagttctggaagaattcccttcactgagctagcaaggccatcaaactctgcgttcacctggatatcctaaggagacacccattacaaggatgaactttgttactatctgagaacttcaccatttttcactcacacacgcaaggtctcagagaagctccttcgggcggcttctcccctgtggatgacagtctcatacccgcaaactagtaagatccaggagagaaggggacaatgggggatgtttagaggcctgctgtatttatttatttagaaatgggatcgtactgtgtcaccaggctggagtgcagtggctcaatcgtagctctcttcatccctgagctcctggactcaagctatctatcctcttgcttaagcctccagaatagcagggactacaggtgcccaccaccatgcccggctatgctgtatttccagatctgggggctggttacatagacacctatgctgtttgtgaaaattctccaagctctatgcttaatctttgtgcatttttcagcatagatgttgttcctcaattaaaaacaaaaaaccaaggggttgtgaagaacagaactggcactgatggagtccttctctgtgcaaggcctttcccttaggtctgtcatctcagcttatgttcatgatggccttgcggggtagacgttagccccatttcacaaaaacacaagtctgagcccagggaaagattttccttgaactataagtcttcaaaactatttccctcaaagctcagaataaaatctgggctagtcagattatactagtgataacagataacaacagttaaggaatagaaggtagaatattcaattcaggctaattgtttttctttgtttttttgttttttgggtttttttgaggtagagtctcgctctgtcacccaggctggaatgcattggcatggtctcggctcactgaaacctccgctttctggttcaagcaattctcctgcctcagcctcccgagtagctgaggttacaggtgagcaccaccacatccagctaatttttcttctatcttttacaacacagagtttcactcttgttgctcaggctggagtgcaatggcacgatctcggctcactgcaacctctgcctctgggttctcctggaggtgattctcctgcctcagccccctgagtagctgggattacaagtgcataccactatgcccggctaatttttgtatttttagtagagacagggtttcaccatgttggccagactgatctcgaactcctgacctcaggtgatctgcctgcctcggcctcccgaagttctgggattacaggcatgagccaccaactccggccaaatttttgtattattagtaaagacaggttttgccatgttggccagggtggtcttgaactcctgacctcaggtgatccacctgccttggcctcccgaggtcctgggattataggcgtgaaccatcatgcccatcccaggctagttattgattgatcgtttatgattctttgactcagaatcttgtccaggatctcacactgatagacacaggatttggtcccaaccctgaactgattccaaagcccatggcattcccacgagactaggggcttctgataatgaccatacattgtgacaagtaagtgtatatttgggcaggataatgccatatgacattctatttcttttagaatgacagatccagtgctgacaggaattctcagagcagcaggcacatggttaaggcaagaacaggccattagaaggaaatggtaaggacgtttgacatcggttgtcccaaacctgaagaattgaaactacacagacacatttctggaaaggctttcactcaagtctgggttgaaaaaaatcagggttagaatcagcactgatttgtaactcaatttttttgtttccttccctttttttttgagatagaatctggccctgttccccaggttggagtgcagtggcacaatcatagctcactgaagccacaaactcctgggatcaggtgatcctcctgcttcagtcttctgagtacccgaaactacgggtatgtgccacatgcctggctaattttttaaaaagctttttgtagagatggggatcttgctgtgttgcccaggatggtcttgaactgtaggcttcaagggatcctcccacctcagcctcccaacatgctaagattataggtgtgagccatctcacctggcactttttctacattaaaaaatcaaaattcaccaggcgcaatggatcatgcctgtaatcccagcacttggaaggccgaggtgggtggatcacctgaggtcaggagttcgagaccagcctggccaacctggtgaaaccctatctctactaaaaaaaaatatcaaaaaaaaaaaaaaaatcagccgggcgtggtggcacacacctgtaatcctggctactcaggaggctgaggtagaagaattgcctgaatctgggagccggaagttgcagagagccaagatagcaccactgcactccagcctgggcgacagtgagactctgtctcaaaaaaaaaaaaaaaaaaaaaaatcaaaattgacccaagacatgagagaccatggcacaggatcacttgaggtcagaagtttgcaaccagcctgggcaacatagcaagcccccatctctaaaaactttagccaggtatggtgacctgtacctgtacttccagctgcttggggagcttagacaggagaaccacttgagccaaggaatttgagactgcagtgagctacgatcacaccactgcactgcaactgggtgacagagtgagaccctgactcaaaaaaaaagtggcaaaattgaatgaaaagggatcctaatctctctcacagccactcaagtgaagcttccagcaccacagtccacctgcagacagtcaggggaggggcagagggcagccttgcaggtgctgcgcctgcagatcgaaacctcagtggatagggagcatcatgcccagacctccacttatcctctctcagccaatgaagaacccaggcaggtgccccaggtgagatcccatggaaccagcagtctggagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttgagacagagttttgctcttgttgcccaggctagagtgcaatggtgagaactgcagcctccacctccaggattcaagtaattctcctgcctcagcctcctgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcatccagccccatgagcatctttaggcatcaatcttttatgcatctctggttatttctctagagcacattagtcaaatgattgtatcaaagggcacaggcagttttgaggctctcagtgcatgatgataaattgccttccaaaaaggctgtgcccgtttgcattctcaaaagtagagtgtacacccctccttatattttaatagtttcctgaggtcaccagaacatgaacatggggagggcagggacttgcttgggcatcttggataccatgcccagttcaatgtgcagtacttagtaggggtttgtgtgacaggaatgagtgagagcacatgaaggcccagatgagtgcagggtccgtggggcacagaggagggtacaggtgtgtgagcaccgtgaaggccagctccataggacttagcacacggctgacgtggggactcagtgcagacacaagtggtaacaaagcagaatggtgcagactgtggcaagttgagaacttatgcctctgtaaagggggcagccaccactcagttactgcagattactctatctttgctgaggacagttgcacaggtagtgcactgcagaagggtaacaccttagagggatgtcatttgcatcatagatgcaaaattcacaggcaaagactgatgtagtttgtccctaaagttttgctttgatttgcagatatttatccatggcagtttcgtgaaaaacgtctatagaaggttttgaggaatgggcaccttttaatttgctactaaactaaaccccaagggcccattatatgccagcgtggtcctagagattccacactcattcagttccttttcatcataggaagtgggcattataatatcaggtccactataagagctggaggctgggcatggtggctcatgcctgtaatcccagcactttgggaggcctacctgggcagatcgcgggagcccaagagtttgagaccaggctggacaacacggtgaaactctgcctttacaacacatacaaaaagtttagccgggcttggtggcatggccctatagtcccagctattcgggaggctgaggtgggaggatcgcttgagcctcggaggtcaaggctgcagtgagcccagattgcacaactatactccagcttaggccacagagcaagaccttgtctcaaaaaataaaataaaataataaaaagaaagaaagagaaaggaacagatcaataggtacaataaagtaatatttgtataaaaaaagcaaaagaacatatttatttatttggatatttgtttatattcataaactatctctagaaagataccaagaaattgaatctatttggttgtatctgagaaactgcaggaatagggacagggttgagatgatgccttctgaattttgaaatatacaaatgtattttctacttagaaataaatgggccgggcgtggtggctaggccgggtgcggtggctctcgcctgtaatcctggcactttgggaggccgagactggcagatcacttgaggtcaggagtttgagaccagccttgccaacatggtgaaactccgtctctactaaaaatatgaaaatggccaggtgcggtggctcacccttgtaatcccagcactttgggaggctgaggcgggcggatcacctgaggtcaggagttcaagaacagcgtgaccaacatggagaaaccccatctctactaaaaatataaaattagcctggtgtagtggcgcatgcctgtcatcccagccactcaggaggctgaggcaggagaattgcttgaacccgggaggtggaggttgtgctgagctgagattgcgccattgtactccagcctgggcaacaacagcgaaactttgtctcacaaaaagaaacaacaacaacaaccacaaacacacacaaaaattagctgggtgtggtggtgggtgcctataatcccagctactcaggaggctgaggcacgagaattgcttgaacctgagaggcggaggtcgcagtgagccaagatcaggccactgcactccagcctgggcaatagagcaagactcaatctctaaataaatatataaaataaataaataatattaagacaaaactcataaggacattacataaaccaagttatgccagtgatttttttaaaatatcaaaacaggcagttttatagaaaaatataacttcaggccaggtggggtggctaatgcttgtaatcccagcactttgggaggccgaggttggcagatcacctgacctcaggagttcgagaccagcctggcaagcatagtaaaaccccaactctactaaaaatacaaaaattagctgggtgtggtagaacatgcttgtaaccccagctacttgggaggctgaggcgggagaatcacttgaacctgggaggcggaggttgcagtgagccgagatcgcgtgactgcaacagagaaattctgtctcaaaagaaaaatataacttcataaaaacaaagtagggagaagcagaaaagtttgtctagatctagaaccattaaaggaattgaatgtttattttaaaatctgtatcccggccgggtgcggtggctcacgcctgtaatcccagcactctgggaggccgaggtgggcggatcacaaggtcaggagatcgagaccatcctggctaacacggtgaaaccccatctctactaaaaatacaaaaaattagccggccctggtggcgggtgcctgtagtcccagctactccagaggctgaggcaggagaacggcgtgaacccgggaggcggaggtggcagtgagccgaggtggtgccactgcactccagcctgggcaacagagcaagactccgtctcaaaaaaaaaaaaaaatctgtatcccatcccctcaaaaatctcacaaaaaaacaaaaccaaagaaaagcaccaggcccagatgattttatggacagcaaacattaaaaagaacataaagtttttatcttctacataatttttaaaaattaattatttatttttgacaggaagtctcgctttgtagcccaggctggagtgcagtggcgcgatctcggcacaccgcaacctccgcctcccgggttcaagtgattctcctgcctcagccacaccagtagctgggactacagccgcgtgccaccatgtctggttaatttttgtattttagtagagacagggtttcactatgttggccaggctggtctccaactcctgatctcgtgatccgcccgccccaatctcccaaagtgctgggatgtgtgagccgccacgcctggccactactttttcttttctttgtgtgtttttttttttttttttttttttttggtgtgtgtgtgtgtgagatggagtttccctcttgttgcccaggctagagtgcaatggtgcgatctcagttcactgcaatccccgcctcagcaggagagcaggaatcttcagtgatccactggcggatctgcagccattgtgcgcgccaggtcttcccaagtcttttgtgcgcgcgcctctccttccagtacctatcaagccagcgtcccctagcctcccgccattgccagcaggtgctgagatcgcgccattgcactccagcctgggagacaacagcgaaactccgtctcaaaattaaaaaaaaaaggatgaaaattttggaaaaatatggaagaaaccaaatggatttctagctcaactaaatcgtaattattcagtgtctagtttttgcaagaaaccatatatttcatgtccacaatcggccacagtcccagctctcaagtgtaggtctttcctaagcaaattgaagaacacaggcataaaagtgcattaagtcaataaacatttttctctgtgtctctctctctctttttttttttttttttttgagacggaggttcgcactgtcacccaggctggagtgcagtggtgagatctcgggtgactgcaagctccgcctcccgagttcacgccattctcctgcctcagcctccagagtagctgggactacaggcgcccgccaccacgcccggctaattttttgtagttttagtagagacggggtttcgctatgttggccaggctggtctccaactcctgacctcgtgatccacccgcctccgcctcccaaagtgccacagccccggcctttttttttttaagacagagtctcggccgggcgcggtggctcacgcctttaatcccagcactttgggaggccgaggcgggcggatcacgaggtcaggaggtcgaggccatcctggctaacacggtgaaaccccgtctctactaaaaatacaaaaaagcagccgggtgtggtggcgggcgcctgtagtccgagctactcccgaggctgaggcaggagaatggcgtgaacccggtaggcggagcttgcggtgagcccagagatcaggccactggaatccagcctgggcgacagagggagactccgtctcaaaaaaaaaaaaagaaaaaaaaaaaagactctgactctgttgcccaggttggagtgcagtggcgcgatctcggcgcatcgcaatcccttcccagcccccgggttcaagtgattctccagtctcagccgccggagtagctgggactacaggcgcgtgccaccatgtctgactaaatttgtatttttactagaaagggggtttcactatgttggccaggctggtctccaactcctgatctcgtgatccgtccgccccgacctcccaaagtgctaggattataggcataagccgccacgcccggccttttgtttttctttttcttttttttatttgaagactgagttttgcacttgttgcccaggctggagtgcaatggtgcgatctcagctcactgcaatctccacctcagcaggagagcaggaatcttcagtgatccacgggcagatctgccgccattgtgggcacctgttcctcccgcgacctttgtgcccgcctctctccttccagtacctattgcatgaccccccacgtccgcctcccgccattgccagcaagtgcctcgcgcgggtacctggctgcgcttattaatccgttaagctcgctctgtcacgggcgccgtgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatccgtggtgtcaagacaactctaagaaggttttccgtgatcctgcaagccctgccttcctttctgggatcctgccttcaatttgattgcacaggtaccacagcaagccagtgctgtgtgctccgagttccagggcgtcctccagctcagccactgcactgagaacatggactctctgtggggcccaggagctgggagtcacccctttggggtccacaacagccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatatgaccagtcatcccagacctcctggacgagctcgtgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcgggtcacacccagtgtgaaaaggtggcagagaaagcaccagggcagacactcgccctcaggaatgactcctccagatccgaggcctctaggcccagtacacgcaagtttcccctgctgccacacaggcgaggggagcctttgatgctgccacctcccgtagagctggggtaccgggtcactgctgaagacctggactgggagaaggaggcggcattccagtgcatcaagagtgcactgcaggttgaggacaaggccatctcagactgcagaccctcacggccttcccacactttgtcctcacttgcaacaggggcttctggtctgcctgccgtttctaaagcacccagtatggatgcacagcaggagagacacaagtcccaagactgcctgggcctagtggcccccctagcatctgctacagaggtcccctctacagctcccatgtctggggagaagcacagaccaccaggccccctgttctcctcctcagatccccttcctgccacctcttcccactcccaggactcagcccaggtcacctcgctgattcctgcccccttcccagctgcaagcatggatgcgggcatgagaagaacaaggcctggcacttctgctcctgcagctgccgcagcagcccctcccccctccacattgaaccgcacattggggtcactattggagtggatggaggcccttcacatttctgggcctcagccacagctgcagcaggtgcccagaggtcagaaccagagatcccagacctcccggaccagctcgtgccccaaacgaaatgccatctcgagctcctgcagctctacgggagacctcccgggacgaaagcggaagaggcgccagcctcatcccactgccagctgaccctcagttcctcaaacacagtgagtgaggacggacctgaggctgtctcttcgggtcacacccagtgtgaaaagacggcagatacagcaccagggcagacactcggccccaggggtggctcccccagatcccagtcctctaggccccgtagacacaagtttcccctgctgccacgcaggcgaggggagcctttgatgctgccacctcccttagagctggggtactgggtcactgctgaagacctggaccgggagaaggaggcggcattccagcgcatcaacagtgcactgcaggttgaggacaaggccatctcggactgcagaccctcacggccttcccacactttgtcctcacttgctacaggggcttctggtctgcctgccatttctaaagcacccagtatggatgcacagcaggagagacacaagtcctaagactgtctgggcctagtggatcccccagcatctgctgcacaggtctgtagtcccagctactcgggaggctgaggcaggagaacggcataaacccgggaggcagagcttgcagtgagctgagatcgcgcgactgcactccagcctgggtgacagagcgagactccgtctcaaaaaaagaaaaagaaaaagaaaaaaaaagttcttgtgacatttctgtatgaaatcagccttcactacatggataggaccagcacgcttccgcggcacgactctgcaatcttactacattttttttattttgtattttatttattccttttgagacagtcttactctgtcacccaggctgaagtgcagccgagatctcggctcactgcaacctccacctcctgggttcaagcaattctcctgtctcagcctcccaagtagctgagactacaggcacacgtcaaaaggcccggctaatttttgtatttttagtagagatggagtttagccatattggtcaggctggtctcgaactcctgacctcaggtgattgacctgtcttagcctcccgaagtgctaggattacaggtgtaagtttatttatttatttaagatggaatcttgctctgtatttattaatttatttatttgagatggagtcttgctccatcgcccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccgtcttggccaggctggtctcaggctcctgacctcatgaaccacctgcctcagcctcccaaagtgttgggattacaggcctaaggcaccatgttcggccatatttatttatttaattatttagagacaaagtcttgctctgtcacccaggctggagtgcagtggcgccatctcagctcactgcagcctctgcctccaaggtttaagcgattctcatgcctcagactcctgagtaactgggactacaggtactcaccaccacgcagggattttttttttctatttttttgtagagacacagtttcaccatattggccaggctggtctcgaactcctgaccttaggtgatctgacagcttcgtcctctcaaagtactgggattacaggcatgagccaccgagcccggcctctcactacatttaagtgatgccatggctcatgcctgtaatcctagcactttgggaggccaaggcaggtggatcacctgaggtcaggagtttgacacgagcctggccaacatggggaaaccccgtctctagtaaaaacacaaaaattagtcaggcatggtggtacaagcctgtaggcccagctacttggaaggctgaggcaggagaatcactttaaccgggaggcagaggttgcagtgagccaatatcatgccactgcactccagcttgggtgacagagtgagacaccatctcaaaaaaagaaaagaaaagaaaagaaaaacatatgatgccggggcatctcggcctcaatacctgcatgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaaggatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacttgtaatcccaacctttgagaggccgaggcaggaggattgcttgaggccgggaattttgagaatagcctggacaacatagccagaccccatgtctacaaaataataagaaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaaattggcctgtgagcatgggtttgatcttcaaacaggacctggagggtagggacagacagtgctgtcacccttaggtgctgaacactcagaaacgggccagcggcagcccttccctcacctgcagacaccagattgggcagaacagcacgtggcacttgcagctcttgcagtgagggcagaacccagtgtcaacccttctgcctgtgggaggggctgctgaggcctgcggagaggccagggtggaggctcgtccccttgtccagcccttggcgtggtctccaccaggtccccagcccaccagtgcagggcgcccctgagcctgctgctgccacgggccctgtctctacccaggacgtccccccaccctcgctgtgtcagggaaatgatcatggtggcggtgacactccgcaggcagggctgctgagagaagctgagaagggtcacactgcaggcagaggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcctggggaggctcaggctgacggctgatgtgggcattgccgagggtaacctgtggcccagtgtatatggccgggtctcctcaagctgcattcattcaagtaggacccagggtgcgtgcccatctccagcccagggcagctcccctgtaagctgggtgagctactgaagccaaggcaggaggcagctgacaacacccacggcccatgcagaggtggtggaaaggctggagtcagcagcaacaccaaatcccggaccaggcagaaaccacccaagactgaggggctcgtgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaagcaacagcggtccctgccccaaccagactaccccactcagtggagttacggatgctgctccagcatcctaacactgcccagctggtgcctgcctgtgctcacccgcaccccccaggccggccttccctgcagcctgggcttggccaccttggcctgattgagcactgaggcctcctgggcacccagccccatcactgcacctgctgcttccagccccaccccacaagctcaggggttcttcccagcggcgctgatcatgaagtcaacatgcacgcaagtcgtctcaggaaactttttaatgaaagtgttggccacggtggtgtgtaggtggctgagctcagattgcagctgctgagacaccagccacttaccaagagaaagccaggctgcttcaaacccagggcccgcggcaaaaaagcatcacttccggccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagagaagcacttttagaacatggaaaagtgtggtcatcccatcattagacagcacacatcctacataaataaaaagtcgtatggggaaggaggttggggagggaataaaaaactggcacagacattgatagactggtttccagtttcaaggtaacagatgcacatcatgagaccagaggaggcagagacaagggctggatttggcttttctaagcaacatgtgttcctgcgcagggctgaatggtcactgagacagagatggaagccaggacaggggagcccactgggcccagataggtacagagagcagaggctcctgttctgtcctcaccacccatgagggtgacactgcttgtaaatggtggctgtgctctcccagcaagaaaaaagcacaactaaatccacactgcacaaagacgcagacagaaagccttcaagtggctctgttttctgctccctgcctcatcaggtccacaagcagagaggagtgtcaggtacatatccctgctgtcaggctccccagtaagctgcgggctcagcaggagctgcccactgacacacaggggacacccactcctgccaccttgggagcggttgccagacagagccgtactgggtgctggtgtcatccagggaccccacacacttccttaaatgtgatcctgcttccctctgcgcagctgcatcctctcctcctgcaggaccgtctggaaacttggctctcagtttgctctcccttctctcctctgcctgccccaagcccctctttctaaaaaagtgatgccacgttcatgggattatttcttgaaaatacttggcggcctccatgcttctgttttctttgagtcaggtagtcaggagggtttacaaacaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggtatctggatctgttggggaaaaaattagaaactatgtataaaacttacaaatattcaagtatcaaaaggttatttaggatgaaagttttaaaacaagtcatcagcaagctgctaccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaggtgcgtagcctgggattccctccctggaggtcctgtcccccgacatttcacaggccttctgagctgctttccaaggaggactaacacggcaacaaaagaaccatttctgcacaaaaatcctggaaagaaaaagaagcaagccgagaatggagtcaaaacgctacccagtgctgactaagcctctcaaaccctgttctaagtggactgtggtttctaagtcagggaaatggaagaggccccacccacacagggacagggccacggcccccacaggatgaagcagcagcgtttattcaagatacaacagtgagggaatccggtcacgttcccttctccccagagagggcgcatcttgacaagtgatcgagtagaaatcttttaaactctaagttaagttcataaaaaccactggtttcactctgtctcccagggccaggcctggcctctgagatgcactggcttggggcgccctcaggtggctgcatggaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatagcctgattagccagaggtttccaggccatctgtccgcctccaggagatggactgggacctttagacatcggtggagaacaggatgctctgtcccttgctgtccggggcagggacggcctccagccgcaagaagtacagcagcacctcgacctgccctcgcggagtggggaagaggagagtggctcagaggggggctcacagctgctggtggggaggtctttggggcccaagtccccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatgtgtgccacaatgcctgcctaatttttctttgtattttttctagagatggggtttgctacatttcccagactggtctcaaacacctgggttcagttgtcctgcctcggcctcccaaagtgctgggattacaggcatgagccaccacacctgaacacttggggtggttttaagcccccagcaaggtgcaccagcaggagcaggaggtggcctaggctccccctatcactcccatccatgcaaacctaggcaagtccctgtctctgaatctcagccaccaccacatacaatgcaagttggaagatgggcaggactgggggtggggcaggcagaggccacctctgtcaggctggggttgcatgggctggagcctgtcttcccacacctgggacatgacctccaaggaccagctgtcagtcatggtgatgggctggccggggttggcagggagcttgctctccttctcggagggccggagcagcatggggccaaagacagtggcaaggttgtgcagggacatcttattgactgcctccttctctgccaccctgtagaggaccaaagcagaaggtgctgtttcaacgccaccaccaggagagaggcagaggggctgtgccgtgctagagtcctcagggagagagtgacctcgaccctggctatgagccaatgcgcccggcctctcactcttctttattcagcataatttattctgacgtatcttcagtgtaggtattctctttttattctcctattcctgttaaacccattgggctgaatgctgtttatttctagaatgtctacacctgtttttctgcaaggtcatttttttttctcgtttgctgttcgtcacatatactttcaagctcatcggttccctccgtgagtacaggtaagtggaggagcctcatggtctgcctcaggtctttgagatgttgagtctctggatctggtcctgctgctggccttttctgtccttgctcatggggcattgtttccgtgaatgtgtggttacttttgactgcattactcattgtcctggaaaaatgactttgtgggaatttttcagacctagggtaaagatgcttcctccaaactaggtttacgcttccttctgccaggtacctcagggcgctgtcagcctaaagccaatttaaactaaatccatcaactgtgaggttttggaatcttctcactggtgtgaatttgggccataagtcccaaattctgtggggtgctctgtggggtggggaccagccttagagttctcatcggaagcccggggtggctggatgggggcagatgttttcagggcaagagcggcttggctcgcctctctggtttctggtttccccagatggtgcctggcggctcctcactgtcttgtcagcccctggatgcctttaagaaaacatccttttattttgtcagcatttttggtacttctcagtgtgagggctggtccaagtatttggcttatcatagttttacaaaaagttggtttctatgaaatcttaagtcacctcttttttaaaaatgtaccttttagtccgggcacggtggctcactcctgtaatcccagcactttgggaagccggggcaggcagatcacttgaggccaggaatttgagaccagcctggacaacatggtgaaaccctgtctctactaaaactacaaaaatcagtcgggtgtagggccaggcgcaggggctcacgcctgtaatcccagcactttgggaggccaaagcaggtggatcacctcaggttgggagttcaagaccagcctgaccaacatggagaaaccccgtctctactaaaagtacaaaattagctgggcgtggtggcgcatgcttgtaatcccagctgctcatgaggctgagacaggagaatcacttgaacccgggaggtggaggttgtggtgagccaagatcatgcgattccccctgcctcagcctcccaagtaggtgggactacaggcaagcaccaccatacccggctaacttttttttggtatttttagtagagacaggattttaccatcttggccaagctggtcttgaactcctcacctcgtgatccacccacctcggcctcccaaagtgctggattacaggcgtgagctaccgcgcccagactaaaagcgcgcccggccgtctactacttcttatagggtgagaggcgggaggatcgcttgagccctgaagtttgcggctgctgcagttggctttgatcgtaccactgcactccagccagggtgacagcaggaccctgactctaaaaaaagaaaaagaaaaaaaagcatatactattaatacttcctccttactataatatttaccgtggcctttatcagactagagagtgcttttatctctcccttttgtaagaaagagcttttagaattatcaatagatggtcaggtgaggtggctcaggcctgtaattccagcactttgggaggccgaggtgggtggatcacgaggtcaggagttcaaaaccagcttggccaagatggtgaaaccctgtctctactaaaaatacaaaaaaattagctgggtgtggtggcgagtgcctgtaatgccagctactccggaggctggggcagagaattgcttgaacccagtaggcggaggttgcagtgagccaagattgtgccactgcactccagcctgggcaacagagtgagactctgtctcagaaaaaaaaaaaaaattattaatagatggtgaccctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggtgcgcggggaacgcccctctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcaggtacgtgcaggagatgggagggcctgtctcttggttcctctcggaagtcctgcccttgccctcgctctcattgcctccccgtccctgtctcccctgacactcgttcctccagaagcccggtaaaccccgtccttacgagccccgcccctagctcttctactacggaggggaactgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcggggatgtgggcggggcataatcgcctgggggcggggccctgagggctagatacgggcggagcgcggagggggcggggccatgaccagctggggcgttgcttacgactggtcctgaggacgtgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgcccccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagtgagcgcctgcgcgggtccgggcggggtgggctggagcgggacacccctccccatcccccccgcggtaccgcctccccctcctcctggaaaccgggccggcgccgcgggcgcggaggtagctggatgcggccctctctccccgcaggagacgcggctgttcggcggtcctcgcgcgctggccatcaggtgagcagggcggtgggcgcggccgcggtcccccacgtgcccgcccgagccgccgcccacctgcccgcctttcgccctgcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaagctcgtgggttcgtcgtctgtctcccatgtcatgtaggagcttgactggcttttcagcctccaaagattccttcctttcttacagctcatggatttagatccactccccagtattgtaaacagcatttttagtttttcaggatacataatttgccatattgccagaaacttgtacatagcatttgacacttttttctttgccaatttgacaagctgcttttttcaagtattgtgatttgaaattatttctactatatttgaatttatttctaccatttgtaacatgttgatcctgatttttcaatgctcccctttccttctgtttgattatttgggaagtcacactctgtattctggtattcttactacttgagctcagctcattgctgtcatcttcccctaaaccgccttaaagcatcttaggtcttttccctctgatcacatgtgctactttttttttttttcttttcttttgagatggagtcttgctctgcgcccaggctggagtgcagtggcatgatctcggctcactgcaagctctgcctcccgggttccagcgattctcctgcctcagcctcccaagtagctgggacttcaggcgcctgccatcatgcccgtttaattttttgtatttttagtagagacagagtttcactgtgttagccaggatggtctcgatctcctgacctcgtgatccgcccaccttggcctccccaaagtgctgggattacaggcatgagccaccgtgcctggccaacattttctccagatatcttaccgagtcctaatttccactgcggacagagaatacactctgcgtgattttaattctatctcatttactgagacttgttttgtggcccagcacaaagcttgtaatgaacattgagaagaaagtgtattgttgctgttgacagagtgattttttttttgagacggagtctcgctctgtcgccaggctggagtatagtggtgtgcaatctcggctcactccaacctccacctcctgggttcaagtgattgtcctgcctcagcctcccgagtagctgggactacagatgcatgccaccatgcccagctaatttttgtatttttagcagagacagggtttcactgtgttggccaggatggtcttgatctcttgacattgtgatccgcctggcttggcctcccaaagtgctgggattacaggtatgagccaccgtgtcaggccgacagagtgtgttctaaatacccagcaggtcaaggtgagtgacaggcttgttcagggctcctgtgtttactttcttgttggtagcgccgtcaattgcttattgtgaaatgccccttcataaacacccatacacattttgattatggatggcccgtcttttttccatctgttattttcatcttagatctgtcttcatatgtaaagtgctttggttataatcagcacataactgggtctcacttcttcaattcatgtttataatccctgacttttaaattgggctggtaagtctattatgtttctccttttctgccttcttttggattagtatcttttaaaactccttttaacttatacgctgactcatattttttattaagacagtctcactctgtcattcagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtctttttcaactctggaaatcccattagaaattgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagagaggttgcagtgagcagagatcacgccactgcactccagcctgggcgacagagtgagactccgtctaaaaaaaaaagaaaaagttgactggagcttttcattcaactttttttttttttttttttgaccctgttacccaggctggactgcagcggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttcaaaatgagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattgtgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataagacaggtagggaatatgtccagtgcaaacagaggactcacacctgtgcatagacagcaccatccattgattgtcgctgcagtccatggcgttaccaaggctgcgccacccacgtgctgccccaggaggcgctaccaggttctttgggccacaggcctctcctccactgcatgtggcggcagggcagggaggtcgcagggctccatgattgtgggacagctttgagggcacatggggcagaggccctcgaaggtcccctcctcagtaggggatgtcattctgatagtactggatcatgtcgtaggtccggctcctgaaaggccaaggaagagtgaagggagattcgaggagccagcagggtctggggtccctccccacagggagccctacctgtccaatcagccccttatggctgcccagcacctgaaggtacaaatgtcccaggcgtgccctcccccacccagtgaccacatctcctgctccaacccgggggactccgaggccacctcatgctcctcagccaaaccgcttccatccgtgggagccactgctctgccccatgggactcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgccggacccgggcgccacctgggggcaggtctcagcttcctctcacgctcctccggcagttccccatgcagatggccacacctgggcccctcctcctagtctgtgaatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagctcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctgggggagaggctgtgtcagggctgccatgggcagggccgtgctggctccctggcccagtgggaggagggtcttccatggggacggacttcagctgagagccacgccctggaaatgtacctttggggtccacatgttggaagatggggtgctgtgaaggccacgcctggcctatcatgggccctgtccccttcccagcatcacctgagtggccccatggcattaggggactaagcattggggagctaagctactgcagccccagaccttagggtggaggtgggttgggcgtagcatccttgacataaagaggcccctgggtgggtctctggtgtggccggcacaagcaggggcccctcacagttgtggtctaggggcagagcctcacccaagaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagagcttgattgtctggccgcgaaaacagggcaggcccgtgtccaacatgagagtgaccagggagacgaccgcgtccatgtagggcctggggagagataggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcacttggtaacccataccgcccaggcaagggctgcccacacgcactctggacaggctgagtgtcctgccctgtcccccacataaggctgccggccatggcttctgcacttgggtgggatgcagacacgctgacctgcctttctctgcagggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggatcgtggggaaggtggttggaattagatgtccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggccctcacccaggctcaccgcacagccaggtagcctcggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacaagtggtctgttttgaggagtggaaaaggactgcaacaggagcaccccctccacccccaacaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccctagctccctggggccggggccaggcaccctctacagcagaacagcttggtggccgacagttcggacctcagagctggaccctgacactcctggcagggtggtcctgggcattctcctctctgtggggtggggatccctatccacccctgggtgccaggggtgaagggagaggagggtggcgctgtggctggctgaccgatgtggatgatatgacccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattctccctggtcccacacccaggatccctgggcctgtgggcactctccctggctctgtacccccactgtggaagcagagcccgaatcagcaagccagtcttcggtagcaggagtgacaggggctctctgtggaagtgggcgtgcaggcacttcctcccacactcagaacttaactttcttctaaggagtccaacccagccctacattcttttgactcccaaagtggcttacagatgccctggtgttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcaggatggtctcgatctcttgacctcatgatctgcccatcttggcctcccaaagtgctggcattacaggcgtgagcactgcgcccggccaggtgccctggtttttttgtgtttttttttttttgagatggagtctcactctgttgcccaggctggagtgcagtggcgcaatcttggctcacagcaacctctgcctcctgggttcaagcgattctcctgcctcagcctcctgagtagctgggactgcaggcgcgtgccactatgcccagctaatttttgtatttttagtagagacagggttcaccattttggccaggatggttttgatctcttgacctcgtgatctgcccgcctcggcctcccaaagtgctaggattacaggtgtgagccaccgtgcccggcccaggtgccctggttttaacccttaacaaaggatgactgaggagagcagggtgtgggtggaggctgggtatgggtggctggggtggggtggagcacacacgacctcccccggcctgtggccaccctggctacctgctggaaggccagagtggactcatccccgtactggcgtgtgaagtagtcgtacatgccgaagtctgtctggcggcccagctggtcccgggaggtgcagtcggggatgcactcgatcaccccgcactaggaggaaaggccagttctgaggcccgctgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagcagctcttctggctcatgcagggcaaaagccaagcacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcggggacagtgggaaaggggctggaaggagaggcctctgggttttgcagaagccctaatttaccccgtggcacctgaaccatataagagaaggaaaagattcacatttctgcatatgagattggactctggcgggcctggagccttggggagcagcaagcccagtccccaagcctactcgaggcctgaccctgcttacctgccggcagtcgtctcccaccttgaagatggctgcctgccaggagatcttctggccgtcggcctcctgcgtgctgcactcatcctcggagtctgagcggcaccgcagacctgcccgcagggagagaggccgctgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgggtcagtgttgggtgctgtgagctagggggcaggaggaatgtgtctgtacactggggtcctgggagggctcggggccagcgtgcagacatggccatgggaggcaggtccctgcaaggggtggcagccccctctccacagctggccacaccgtctgtactgggttgaagagtgtctccctaaaattcatgttcaccccaaaccttaaaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggagtgccaggactgctggcaacaccaccagaagctgaggaggcaaggtgtgacctgcccagagccttcagagggggcacggccctgatgatggactccagcctccagaactgagatcgtccgtacggtagccctgggaaactaacaccccccaacagccccgggcccctcagcctcaggaaggagcctgctggagcatgccagctgactcacggcagacagacctctggggtggcacatctgtcagtgcatttgagctccctgccatcccccaatgagggatctgactgagtgagggcagacagatggacagacatcatcttttatggagagctatactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcgcacgcggacgcgtggaagtgggggatgggtagggtgaggcgcccacctctgcatcggggtcccagacttgtagtcgatgtccagcacaatggcctcagggttgctgggcaggtagcagcctgtgcagggacagaggcagtcacagggagtgcatgtgtcaccacaggtgagccagagtcagtttccaacacggatgttacatgcgtgtccaccctgcaggcacaccccgcccctgtggaggggcctctggtccttgtccagggcaccactaacttattattccatggccgctaagggtccgtcctccttgactcttcgactcttccagccatcaaccaaataagtctgcaccttctgggaaatgctcttcctggaggagcactgagccccatcctcacggatacagccctactgcttctgggggtgcgtgtgaggcctgtcctgcctccacctgcctgagcaaccctctgaacagccctccattcttggagtccttttttttttttttggatagagtctcactctgtcacccaggctggagtgcagtggtgcgatcttggctcactgcaacctccgcctcccaggttcaagcaattcttctgcctcagcctcctgagtagctgggattataggcgcctgtcaccatgcctggctaatttttgtatttttagtagagatggggtttcaccatgttggccaggctggtctcaaactcctgacctcaagtgatccacctgtcttggcctcccaagtgctgggattacaggtgtgagccactgcgcctggccttccttacccatttgaatactactctctcaaaaggcttacttaaatgtcactatgtccatgaactgtccttggttctcccagcctttaggacttttgtctaagacgtttctttttttctttttgagacggagtcctactctgtcgcccaggctggagtgcagtggctcggtctcagctcactgcaacctacgcctcccgggttcaagcgattctcctgcctcagcctcccgagtagctggaattacaggcgcctgccaccgcgcctggctaatttgtgtacttttagttgagacggggtttcaccaagttggccaggctggtctggaactccttacctgaggtgatccacccgccttggcctcccaaagtgctgggattaaggcatgagccaccgcgcccggccaacattgtttctttatgtttattttatatctctgtgagttcaagcttcttcagctcagggaccatgtcttactcatctttttaacagctacaatacctaatgtcatgccttttcttttcttgtttttgcttttttgagatagagtctcactctgtcacccaggctggagtgcagtggtgcaatctcggctcactgcaacctccacctcctgggttcaagtgattcttgttctcagcctcccaagtagctgggattacaggcacgcgccaccatgcctggttagttttttttttttgagaccaagtcttgcactgtcatccaggctggagcgcagtggcgcaatcttggcttactgcaagctctgcctcccgggttcacgccattctcctgcctcagcctcccgagtagctgggactacaggcgcccgccaccacacccggctgattttttgtatttttggtagagacggggtttcaccgtgttagccaggatggtcttgatctcctgacctcaggtgatccacctgccttggcctcccaaagtgctgggattacaggcatgagccaccgcacccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttcttcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccgatgcgggaacagaggccctgcatacatgtcctgccctctctgggaagccgtgctgttgtgtgagctcaacacaatgtgttgggaagaaatggttaaaccggggtcctgcagggcactccacagctgagaccagccgctgtgaacatctgcacaggacagagtttggaagacaagtttgtgccaatagttagaaatgcagagagaggccgggcacagtggctcatgcctgtaatcctagcactttgggaggccgaggcgggcagatcacaaggtcaggagattgaggccatcctggctaacacggtgaaactctgactccactaaaaatacaaaaaaattagccgggtgtggtggcgggtgcctgcagtcccagctactcgggaggctgaggcgacacagcgaaactccatctcaaaaaaacaacaacaaaaaaagaaatggagagagagctgcccagtgaagtctggatttccatcttctcttgaaaagctcagcttgaattcccatgtggccacagccacaggcacccaggagcgacttcccatggaggcggtgggggggtggtgctgatgggtcccagcacacctgagccgtcccacactgggcccgccatcccctcgtctgtgtgacctgctcctgtaatgctggagcctaggaaccctcttctagagtaacagctactgaggtcactgtcagcctccagaaaaacagcaggcagcaaggaagatgaagggcacccactgacgagcagctcccgctcactagcggcagattctggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacccggctgcaccttcacttcagacagggccgacagacaagccttctttctctcgtcgcctttagggtagggcctgagaaacaggaaagaaattcttgctttgtctcctggaggaactggctgctgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcgtgggttagaagctgccagcactgctattctcagcacccagcccagaaaaggacctcaaagtgaccaaggtcagagcagtgtaagcactggagacagcccagccagcgtgcccagcattgatgactccagggtttcatcccttatgaatgcacaaagccatcaacatccaaggatggtgtcaggtccacatgaatggaaggtctaggaaaacgatgacaggacctgcaaaggcagtctggttttcctgacaccatgaggatcgatccttcaaagtgtggagagggcagggtggcctcaaattgtggagccatgtgctaaattccacaaacctcaggaatgaaactaagctgtgtttcctgaaactggcgtggccgtgcattctgccataccttcaagagccctggctcaccccaagcagtgcttccccacccaccctggctgtccatcagaaccaccagcggccccgctgctagagactctcattcatctggttggggccaggcacgggtatttttaaagcttcccaggcaattctgttaagctgcagggactggaaggagatcccagaaggtggtttctgaagcactgcacttacttgatgatagccgacacgttggtgatcttgttaaagaaatcaaactcccgctggtaaaagtccttcgctgggccggacaaggagcctgtgatctcctctaccaactgatccaggaggtcgccgatgtcagctgccaaggaagcaaagaggcttaagtctctgtggctgtggcagaggcccctcaggaataccagccctgtttcccaggccccagactggcagtgcccagagtatgctctgcaggcttggtgagaccataacagctgccgtgtgccccttttgctgtgttgacacagctgacgctgctgggaagctaagctggtgcctaagcggagctcaaggcaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttaatagaggcacacagtgggcggggctctatattaaatagtgcctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaatgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaacagcttcccttaaaaactctttctgggccgggcgtggtggctcatgcctgtaatctcagcactttgggaggccgacgtgagtggaccacaaggtcaggaaattgagaccatcctggctaacatggtgaaacaccgtctctactgaaaatacaaaaaaattagcaggcgtggtggcaggcgcctgtagtcccagctactcgggaggctgaggcaggagaatggcgtgaacctgggaggcggagcttgcagtgagccgagatcgtgccactgcactccagcctgggcgactaatcaagactctgtctcaaaaaaaaaaaaaaaaaaaaaaaaaaccctttctggtaagactggcagatgtgaacaaatatgatttttccacactgtacaaagaaatgcatcaacctttgaaagatgtgcataactcactggcctatattttacaaatgcccaccgtttgatgttataaaagcttttgtgggtccaggtgcgacgtagacagacttgaacaaaacacagcatgagaagtttactgccaagtttaagatgccacactgcaattaaccttttttttggcgatcctcctgccttggcctcccaaagtgttgggattacaagcatgagccaccatgcccagactgcaagtaatcattaagaagctaggctgagctacaaaaaattaaaaattagccagtcgtggtggcgtgcacctatagtctcagctacttgggaggatgaggcaggaggatcgcttaagcccaggtggtcaaggctgcagtgagccgtgattgcgccactgcattcctgcctgggagagggaccctgcctctaaaaaaataaaacaaaagctaccacttctcaagtgtggtgcagtatcaaaaagaatctccacaatgacctgagagactactaacatacaacttcctttttcaactacattcacttcaactgaaacaacactgcaacagatcaactgcagaagtggaacgagaatgagaatccagccgtcttctacaaggaaatgccactcttttggctcattttttagttttttggggaaagttattttcccaaaaagatgttatttatattaacatgtaatgaatgggcttacattttctgaaattctgtcttaatctctaatactcgttaacactgacagctaatgctcacattaaacagcgctctttgaggacctcaataaacatttctgacagtgcaggggtcctgaggctgtgctatttgggaaccgctgccctgggctgacggccccttcctcacatgcagtcacagttgtgttgaccatggagactctgcagaagcagccactggagcagaagggtctcactcgcacttgggagtgcagggtggcatcggacagcaagttagcaaaggtgtcatgaaggaggggtcctgctcccctgtgtgctgaaaggtgagaagtgccccagcaaagggtgggagtggaggggtcggtgagctggggcagtgcaggctggcgagagccctgggggctgtagaaggtgcttggcagtgcactgaagacagtaagtgaggcctgtgggaggacaaaatactcacggtctttctggtggccctcttcatctagataaatgttagtcttcatgttccagatgaactggtgtgccagaagctgggatttagacgctgcccacagaatatactcccgcacatagcccatctgcaggagagcaaggtccctgtcagccaggctcggccctctccatgaggagggccttgtcagcagctgctgactcccggcatttggtagaccaggcaagggtaaggcccggtggctctagtggtgtggacaagctctccaggattgatgttgagtccagccagtggccaggccaagttccagctggctgggggctgggacctggggggcagggttgcaaagcgggcgacagtcagcctttgtctcctctgtgtcttcccatgggtttaagaagcacaactctcaaaccaatttctggagttgtcaagtacgagaaaaagcaggctgggtactaaaaactcacttgtgagctggttgtttagaacaatgttccaaagtgacagacaggttccagaaacatgcagagatacctccttcacaaactgacacactgatatgattaggttttgtgtccccacccaaatgtcatcttgaattgtaatcctcaggtgttgaggaagagacctggtgggaggtgactggatcatggggacggttcccccttgttgatctcatgacagcgaatgagttctcaggagatctgatggttttataaatgtttgacagttcctcctacacacacacttgctctctttcgcttgctgccaggtaagacggacctacttccccttccaccatgattctgtttcctgaggcctccccagccacgtggaactgtgagtcaattaagcctcctttataaattacccagtctcgggaagtttttttgtttgtttgtttgtttttgagacagagtctcggtctgtcacccaggctgtagtgcagtggtacaatctcagctcactgcaacctccacctcccaggttcaagcaattctcttgcctcagcctcccgagtagctgggattacaggcgcacaccaccacatctggctaatttttgtatttttagtagagacagggtttcgccatgttgttcaggctggtcttgaactcctcacctcaggtgatccacccacctcaacctcccaaagtgctggaattacagttatgagccaccgcacctggccaggaagttctttatagcagtgtgaaaatggactaatatacacaactgtggtcaccatcctaaggacctatcctcctcttccttcttggtcattttccgccactcatagtagtaactccagtttttctttttaattaaaaaaattttttttgttcctagagccataagttttgaaactccagttttaattccatgccctaggtttaaaaaggtgagctggcctttctgggcagcctcctggagtctgtggccactgatctggtgaagtgtcccttggatggacatttttgacctgggtgagtcgggggtggtcttaccacacaggcagaagtcttcactttgggtttcccaattctaacccggcaaatggatctaaagacaaactatgaatgttcaatgtgtagtgtttttaaatataagtttgctttttaattatgtaaacactgacagagttccaaagtcaaaattattaaatatggtacatatctgtcagttccatcctgatctctccctctttggccatttttattaacttttgatttactgttcctttttttttttgagacagagtctcgctctgtctcccaggctggagtgcaatctcagctcactgcaagctccgcctcccgggttcacgccattctcctgcctcagcctcccgagtagctgggactacaggtgcccaccaagcctggctaatctttttttgtatttttagtagagacggggtttcaccgtgttagccaggatggtctcgatctcctgacctcgtgatccacccgcctcggcttcccaaagtgctgggattacaagcgtgagccaccgcgcccggcctactgttccctttttttgtaaaagtataaacaaatatgtatatacatttgtattgccatagtgatataaatttttttaaacttaaaaaatattccaggctgggtgtggtggcacacgcctgtaatcccagcattttgggaggccgaggcaggtggatcacctgaggtcaggagtttgacaccagcctgaccaacatggggaaacctcatgtctattaaatacaaaaataggctgggtgtggtggctcacgcccgtaatcccagcactttgggaggccaaggcaggtggatcacctgaggttaggagttcgagaccagcctggcaaacatggtgaaaccctgtctctattaaaaatataaaaattagccaggcgtggtggtacacgcttgtaatcctagctactcgggaggctggggcaggaaaatcacttgaacctgggaggtggaggttgcagtgagccgtgatcgtgccactgcactccagcctgggcaacaaagactctatctcaataaataaataaatatttattatttttttgagacggagtctcactgtatagcccaggctggagagcagtggcatgatcttggctcactgcaagctctgcctcccgggttcatgccattctcctgcctcagcctcccaagtagctgggactacgggctcccgccatcacacctggctaattttttgcatttttagtagagacggggtttcactctgttagccagtatggtctcgatctcctgacctcgtgatccgcccgcctcagcctcccaaagtgctgggattacaggcgtgagccactgcgcctagccattaattaattaaaataattaaccaggtgtggtggcacatgcctgtaatcacagctgcttgggaggctgaggcaggaaaagtgcttgaacctgggaggcagaggttgtagtgagctgagatcacaccattgcactccagcctgggcaacaagagcgaaactctgtctaaaaaaaaaaaaaaattctggctgagcgcagtggctcatgcctgtaatcctagcactatgggatgccaaggcaggtgaatcacctgaggtcaggagttttgagaccagcctggccaacatggtgaaaccctgtctccactaaaaatacaaaaaataagccgggcgtggtggcatgcaccttcaatcccagctacttgggaggctgaggcaggagaactgcttgaatctgggaggcagaggctgcaaggagccgagaatgccactgcactgcagcctgggcaacagagcgagactctgtctaaaacaaaacaaaacgaacaaaaaaaaattccctaaaaatggaaagcaagaaagaaaccagtgaaactagctgagtcctgagttggtacaaccacacacagaagaatcatttcaggcggcctttctctggtagccaccaccaagagttcacacggaggccctgggtactggctcccctccccactgcctctggatctcacccttatgctaggcctgtatgcaagcagagagccaagcagtcaagggaaaataatgtgggaggggagccagggggaaggaaacaggttgctgaagagaaggtgcctcatgacaatcctgtaagttgccaccagtgtgaaggctccggcttggtgagtgtggctccacacatatcaccactcagaggcgcagagagtgtggcactacctagtgagggcagtgaatgattccacaggactcagtctttcagcagaggctggctgctgttctagaagcactttggtctacagactccaaggctagcccctgggacacccagccatgtaactcagccagcccacaggtgggccagagtggtgaggactcagccaggacacatggagtctgctgcccaattcatccagggaaatgaggtcagccctggggttggggaatagggcagacaagctgcactcagacacagggtgcagtgggcaggctggcgcgagggcagaggcggctcgggctcctggctgtggtcattcccatggatattttctgtgccatgacctgtgctgagcactttatgtccatggatactgttacgggctgaactgtgtcccttcaaattcatatgttacaggacctcagaatggtactgtatttggagatagggtctttatagagatgattaaggtaaaatgaggtcaatagggtgggtcctaatctagtatgacaggtgttcttataaggggagattaggacacagacacacacaaaaggatgaccctgtaaggactcagggagaagatggctatcaataagccagggagatgggcacagtggctcaggcctataatcccagcacttttggaggcggaggtgggcagattgcctgagctcaggagtttgagaccagcctgggacaacatagcgaaactccatctctacaaaaaatacaaaaattagctgggcgtggtcgcacacgcctgtcatcccagttacttgggaggggtagcggggaaggtgctgaggtgggaggatagcttgagcccgagaggttgaggctgcagtgagctgagatcacgccactgcactctagcctgagtgacagagcgagaccctgtctcttaaaaaaaaaaaaaaagccagggagacaggcctcagaaggaaacaaccctgttcgaacaatgaccttggacttctggcctccagaattcatgttttttgtttgtttgtttgttttgttttttggcctccacaattctgagaatgagaatagacatttctgtcgtttaagctgcccagtctgtggtgcttcgctatgcagccctggcagactaatgcatatgtcatctcgttaattttcctcaccacttccggctgaagagggcaggattcagggatttgaggggaccccaccgatgagagggaagcctggccaggctgcctagccaggctggcaacagccccagaaccggctcgctccacagagcatgcttgggcctcagggtgaggcagtgggtgaacatgggtatcaagggacaatcacagggcctggggtagggggagcaaggggactgctgggcagccctgcccctgaggaggctctgaggagcctgtgagggctggggacagaccgggcacaagctggtgtggaacacactctgtgagtgaagaggacggccatgcaggtgcaggcttaccttgtcgtacctgagggcctgcacaatctgggggatgtagaagaggatggcgtcctgtggaggtggagcagagttggccatgacttctgagagcagagccacccaaccctacggcccaggccctgcctctgcttctgctctgcccacagcagggctgagaactggggaaagcccagaggatggcaggcaaaatgaccgatggctcagaacacaggaatggaggaaacaggtaaaaggagcaaggctcccgctctacagcgggcgagggcctcgtgctcctcactagggagcctgcctcagggaatggtctgctgtgggtcagactctagaatattccagagacccttctccaccatcatcatggctatctcgtgggctccctgggctcccacaaggagtgagggaccctccacgggtgaggtcactgtggggttccaaggcacagctagctgcactgctgtgtggggtgtgcacagctgccgcgccgcctcgtaatcaaactcaagttaactttatgtctttaactcaaacgcctcactagattaaaaaacaaatgtaactagagaacacatttgaattagaactaaatccatcttctacaactacttgagcaaaaaacagggaaaggaccagtatgtaacggggcgacctcatggccaatggtggggcctgtgcctctcaccaggtaagacccctcccaacagtcctaccagaggccagctcagcagggccctgggctcaccggagggaaggaccgcaggactttcaccccgtactgcgccgtgagagggtgcggcgggtacatgctggagaagtaggagaggcctgtgggtgggtccgtgggcgcccagcacagcacatggctgagctctggagcatcggcgtcgatggtgtgccaggtgaccaggaactgcagagaaggtggggagatgctgtggcttgggcagtcccgggacctctggaaatacctggtccacgggccacacaaggacggccatgagaagtgatgtttctaagcatcggtaaccatggggaagatgcttctgatgtgttatggaaaacaacgtaactgcaattagggtgaagtgcattacatttttttctactgtgaacaaaataaatgctacagacaagaaatagaaaacacaggaaatcagaaaaaccatgaatagcactgaagttgccaagcggctgtttttgtctcatttctagtttcaggcatttctgggtgcagtgtgctattttgtgcagtttgaactcaggccctggtacgtgggctacactaccttgattgcttcaggcacatcactaacggctcccgggtccaaccgaacgagacgggtcacttcgttcccaatggcttctgtgttcttaaacctacagtgcacagagggtatgggtggtgctgcctcgccagggaacctgcactctcccaccacactggagtgaggggagccagggggaaacactgaactggagggattcacatcaataccaagtgacggcttgggtacaaacaaatagaaagaatgaagacctgctatttgatagcacaacagggggactacagccaataataacttaattgtatattgaaaaataactttaaaagagtgtaactggattgtttgtaactccaaggacaaatgcttgaggggatggataccccattctccaagatgtgcttatttcacgttgcatgcctgtatcaaaacatctcatgcacctcataaatacagacatctactacatatgcacagaaatttaaaaaaaaagtttaaataaaaaaatgtttagccaggtgacggctaaatgttctattatgccactaactagtaggtctgaacattagtgttttttaaaaagaggattataatctgctgtgatgaaatgctggaactttcttaaagaaacaggaatttttctacacttaactgtttaaagggcttcctttcaccatccttgtcttaaaacccctgcctcttactccttttcctaccatatcctctcctgactctccacagctgctcatccagtgagtcagtgtctcagtcaacagtccaggggccacaaggcacctggtccatgaaggggcagctactggtttccaggtgttcccacctcaggctaatgcaaggcggatgtcccatgagcactgtgctttgagacaatgcagagctgcgctgcgatcctattccagaggatcaaagtagggctggagagaggatgcagtacattggcaagtctgggctcacaatggagaatcacccaccctggacacattcacaggaggctgtggaccatctggtgggattctaaacagggactctgcagtccctctcagccaccatcggtctgaagttctgtccccataagagctgccacagagagatcacaggaatgtcactgctgtctgcagcatgtgcctcctccaaatactctgccactgaaaggtgacatccaggaacaaacccaaaccctccccaaggcggttccggcagccacctgccaggagtgacagcctccacatgcttcctatccggcaggaatcagatcttggctctgaattcaccctgctgctacctccctaggctccagctgctgcagcaccccaggcaggcatctgaaaagatcacgagggttgctgggttatctctgcacagaagggctcggggagtgtcctggggctcgaggactagactacttcctgactatccttgaaaggggctgcagggcactcctgagaactcatgacccagctggcaagcaccctgcgctggacctctggtgaggcctgtgtcaggctgtggtgcccgggggcccacctggcaggcagctgcacggctaggtagggagagatgctccaggcgaggttcacgttgtccttccactgcttctcactcaggctgatgtacttagatctccagttggccacgctgttctctccggcctggtctagttccagttccggggctgacagcgggttgtaccatgtgatgagacgctcgatctcagtggcctggcaagataagacataaggcctgatatgcaccccttctgtgagtgcccacacactgccccggccaccaggtgtcgtacaggcaggtggcgggcagcaggcacagctgcacctgtgggccttaccagcagggacagcagcagcgtcctgcgcttcatgtagtatttgtgcagctgggagccccggttggttttcttagacatgcctaggaggaaagacaaagcacaggtgtagtcctcagatgctacctgtctgccctgagattctaaacctagaggaagcttgcagtgctctgttctgctgtctgagcaagtgtccatcaagcagcttgcaactagaatgatagcttgcatgtgatggccccagcagcacacctcccaccgacctgatttcttggagatggtggacatgccgctggacagggggtatgtgttgatccagccttgggtggcttgttgccgagagccgacagttatgtccaggttgctccgggtgtcctgattatctgagggcaaacacattgttgattctagagtgaggtggctcaagaaaaggtaccacaaaaaataaactactattcaccagagataaagcaattagtggcagagcaggcattttctggagtcctggaatcgactgcaggaacaaatctgtctggatggtgggttttccaaaagcatgagaagttctttattttaactattctagatggaatgtttaaacatttttattatatttcttttaaccttttcaaaatttatttatttatttacttatttatttttgagatggagtttcgctcctgttgcccagggtggagtgcaatgacgtgatctcagctcactgcaacctccgcctcctgggttcaagtgatcctcctgcctcagcctcccaagtagctgggattacaggtgcctgacaccatgcccagttaatttttgtatttttagtagagacaaggtttcaccacgttggccaggctggtctcaaactcctgacctcaggtgatccacccacctcggcctcccaaagtgctaggattacaggagtgagccactgtgcccagcctatgttttatttttgagaaggagtctcgctgtgttgcccagactggagtgcaatggcgcgatctcagctcactgcaacctctgcctcccgggtttaagcaattctcctgtctcagcctcccgaatagctggactacagacgcccaccaccatgcctggctaatttttgtatttttagtagagatggggtttcaccatattagccaggctggtctcgaactccttacctcaaatgatccacctgccttggcctcccaaagtgctgggattacaggcgtgagtcactacacctggacttcttctagcctttaaaatagaataggctgagcacagtggctcatgcctgtaatcccagcactttgggaggctgaggcaggtggattgctagacgccaggagatcgaggccagcctggacaacaaggcaagacgccctatctctacaacaacaataaaaattagccaggggacctggcatgtgtctgtagtcttagctgcttgtgaggctggggtgggagaattgcttgcacccaggagtttgaggctgcagtgagctatgattacactattgcactctagcctgcgcgacagaatgagactgcatttctaaaaaaaagtagaaaataaaatagaataaaacaaatatcataattttcttgataaaagatggcagttatctgatcaccggcaacgtatagtcctttagtacggtgacaacttgagggcctgtgggggcagactgtaaggactgtttgccctcttctaagtggagccagaaagctgccttagaaagtcactgcatctgcttttttctttccttttcctgctagttaggttgtcagccgtgggtctgctaaagaaaaccatctcagccaggcaatgtggcccacacctgtaatcccagcactttaggaggctgaggcgggcggatcagaaggtctcagccaggcaatgtggcccacacctgtaatcccagcacttcaggaggctgaggcgggcggatcagaaggtcaggagtttgagaccagcctggccaatatggtgaagccctgtctctactaaaaaataaaaaaattggccgggcacggtggctcacgcctgtaatcctagcactttgggaggccgaggtgggcagatcacgaggtcaggaaatcgagaccatcctggctaacacggtgaaaccccatctctactaaaaatacaaaaaattagccaggtgtggtagcgagcgcctgtagtcccagctacttgggaggctgaagcaggagaatggtgtgaacccgggaggcggagcttgcagtgagcggagactgcaccactgcattccagcctgggcgacagagtgagactccgtctcaaaaaataaaaataaaaaaaaaagtctgggcgcggagatcgagaccatcctggctaacacggtgaaaccccgtctctactaaaaaaatacaaaaaattaggcaggcgtggtggcaggcgcctgtagtcccagctactcaggaggctgaggcaggagaatggcacatacccgggaggcagagcttgcagtgagccgagattgtgccactgcactccagcctgggcgacagatcaatactctgtctcaaaaaaataaaattaaattaaattaaaaaataaaaataaataaataaaattaaaaaattagccaggcatggtggtgagcacctgtagttccagctactcaggaggctgaggcaggagaatcgcctgaacccaggaggcagaggttgcagtgagccaagattgcgctactgcactctagcctgggagaacagggcatggcctccttacagaggtttgctgcttctttgcgtggcatgttttcattcggcatacccttccctggaatgctttgccctgtccaccctgcatgccggtgcagccattcagactcagctcaactgtctctcttccagaaaaccatctctgattcctcaactctggatgggccaagtgcctgtccccgaggagtgctcccatagttccctcatattgaaatcacctgtccatttgactgcctcctacaagacaacaacagaccataccccagtcatgtgggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagccaaggccagggctcaggggggtctaactgcttttccgtccctacctctggcaccctcggggcagcccacgtggcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtagggaactttgggggacagcttcaaacaaccataagaggacaagggctgagtgtctggagtcagggactagaggccagtcacacaaagcagtgagaaggtgatgcagacagtttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtttggggcgatggagcacttggaggggctgcgccgtccctggacgctgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccagttagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacgtgccggttcatgctccccttggccccgccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttcgtgggggaacaggcacgtacgtcgatccagatgtagtggggggtcacttcggggggacagggtttgggttgacttgcttccgaggcagccagggggtctgcttcctttatctcagcagaaaacaggccaaatttctgctccaccgtcatgtgccaggcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgccttctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggatgctgagctggcaagggcagaagagggttctggatccagagcctggctcctcctctccaccccacacagaccctacctgatgccttcatcccgctaaccagattaggaaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtaccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccttttgcactctgtccttgtcttccttcctgctgggaggcacagaagccatctggaggctgtgagggtggagacaaaggccacataagcccaggatggccaggagccgacgggagcccggggcggggctctgtctgctgcttccctctaagctgcccatggggtgaggactcctgggggacgaggcactagagcctgctttctgtttcctgcagaccgattagtcttatggaagcagacaagggagaaaaaaatgggggggaccccagaactgccatggacaagaagccatggaagagacacactcccacctatttgttacacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtgacagaccaggtggccagggagagccctggcaaggaggggatatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcaaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagagggcagcagctgggatgctgggacttgtcagatcctggataaacctcaaaggtgaaggtgatgggatgtgctgagagtcatctgtgggatgtgcataagagggagtcaaagacgtctgagcagacagaaggacctcgctggcatctacagtgaagggaagggccatgctggcatctacagtgaagggagggaccttgctggcatctacagtaaagggagggacctcgctggcatctacagtgaatggagggacctcgctggcatctacagtgaatggagggacctcgctggcatctacagtgaagggaagggtcacactggcatctacagtaaagggagggacctcactggcatctacagtgatgagagggacctcgctgacatctacagtaaagggaggggccacactggcagctacagtaaagggaggggccacactggcatctacagtgaagggaagaaccaccctggcatcaacagtgatggcggatgggcgaccagtgtagcggtgtctggagctgtggttggacccattagttggggctgctaatcagttcaccatgcaggctgtgggccaagccactgaagggatgcacctggactaggagtgactgggctgggtaagcagtggagctggccagagtacccaggcagggaggaggagccctggggcatgccagtactgagaaggccctgagctcaagaaggtccctttattctggaggatgaaagggctacaaaaattacaaaggccttaagtccctgggaaaagcagttaggctcccagaacagctgctttcaagacccagaactctgaaggaggctgtgagcagctttccctaggctgatctgtcctcctaccatctggggcctgctagtgatatctgtactccaactgccctgcccccaggggtcaaccaacccactcctatctgaggacccactcctatctgaggaccagacagggaggccagaagttcaagggcacctggactaaggaagtggagaggagagaggtggatctgggctccagagccccaggtacaatgtgagggctgacacgtggtcaggagcacccccagtgccctatgaaatgggaacggctacagcccctactctttttcttttttttttttttgagacggagtttcgctcttgttgcccaggctggagtgcaatggtgcgatcttggctcaccgcaacctccgcctcctgggttcaagcgattctcctgcctcagcctcctaagtagctgggattacaggcacatgccaccacacctggctaattttgtatatttagtagagacagggtttctccatattggtcaggctggtctcgatctcccgacctcaggtgatccacccgcctcggcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggcttccagaagaccctgagaggagggcacacttgtcctcttctgggaagtggagagtcccaccaagagatagtgtgtaggcaggtgtgtgtaggcaggtgtgtgcaggcaggtgggcacctgggcccacacaggagtgagcgtggctaagacttcccaggatcgggtccctcctgagcccacaggaggacagcctcagggtgtgggggaaactgcaaccatcagcctagaccccaaggcctgggttcaatggacaggagagtaatatacatataatgccctgcttaagttgggcacacagcaggaccagagcaagttatcagttactagtgcagcccacatgcatttattttgggtcatgaattttaagtatcatacaaggatcatgaatctttcccctctcagtgaaatgaaggtcccagacccctgtaaggaggtcaggctccccactgttcccacgctgagatgcgaacagcaagtgtgacatctcttcatctcctgggcactatgggacctggacaggtcaggtccttgtggaggcagagacagggagtgaggacctgaatgaccacgtgctgctggggccagtgccaggtgtgagtgtgagtgggtggagaagcctgacacaggccaagggacctgaggccagctgagccactggagatggtaggagcaggaagtgcaagctggactccaaaagaccccaaatgaaacagtaatttggtttgtataaaaatccctttaagacacctttcccaattttgcttaaaataaaaaaaaaaggaagtggggtaaaaagcaggaagaacccatacttcctgccaagaccagctattgagtaggaggaggagccaccagacataagaaagacatctcggacaggcgcggtggctcacgcctgtaatcccagcacttggggaggccgaggcaggcggatcacaaggtcaggagatcgagaccatcctggctaacaaagtcaggagactcagtcacaaaaaaaaaaaaaaaaaaaagcaactggctgggcgcagtggctcacgcctaaaatcccaacactttgggaggccgaggcgggcggatcacaaggtcaggagatcgagaccatcctggctaacacagtgaaaccccgtctctactaaaaaatacaaaaaattagccgggcgtggtggcaggcgcctgtagtctcagctactcgggaggctgagacaggagaatggcgtgaacccgggaggcggagtgagccaagatcgggccactgcactccagcctgggtgacagagcgagactccatctcaaaaaaaaaaaacaaaaaaaagcaacaacaaaaaaagtcccagctactgggtcaggaggccgaggcagcagaatcacttgagctcaggaatttgacgtcagcctgggcaacatagcaagactgtcttcaggaaaaaaaaaaaaacaaaagaaaaaaaataaagacctccttctctctgggaaaatatacagcagtcctcctcaactgtcagttttatttaaatgtacaatgtccagtatagaaacaaaaactttcaaacattgaagaaaaaagataaaaagaaactgacccaagatgactcaaatacaagaacagaccagataacgatataaaaataattacaataaatatgctcaaagatttataagaaataatggaaagaatgcatgaaggtaagagaatctcagcagcagaaaatgcaaactataaaaaagaattaaatggctgggcgtggtggctcatgcctgtaatcccagcactttgggaggctgaggcaggtgcatcacctgcggtcaggagtccaagaccagcctggccaacatggtgaaaccctgtctgtacaaaaacacaaaaattagccaggcatgatggctggtgcctgtaatcccacttacttgggaggctgaggtgggagaatcacttgaacccacgaggcggaggttgcagtgagccaagattgtgccactgcactcctgcctgggcaacagagtgagaccccatctcaaaaaaaaaaaaaaaaaaaaaaaaagaattaactagaaatcctagatctggaattgtttctttttcttatttttaaattaaatatttattttttgttttgttttctagacctgagaattgtatctgaaataaaaaatatacaagatggttttacagcagaatgaataaagcagaagaaaagaacagtgaactggtatacaggttaaaaaaaaaattaaccaaatgaaagagtgagaaaaaccctgaaaaactgaaaaagactacagagaatgtcgatgatctatgggacaataccaagtcactaatatatgtgtacctggaatccaaaaaggagaagagagagagaatgaagtaaaaaaaaattaaaaaaatattgaccttaagagcctaggaagtaaaaaaaaaaaagaaaaagaaatgacaaagaaatactgacctcaagatttccaagtttgatgaaaatcctaaatccctgaaattaagaagctcaatgaattccaacaggataaatacaatgaaattcacacacagtcaaacaactaaaaatgaaagataaggagaaacatccaacaagtagtcaaaagaaaaacaataacatatacagtcatccttggtatcctcaggagaactggttccaggatgtggaacccatggatatggagggccggctgtactgagaaacaaaaagactgttgacttctctccagaaacaatgcaagctactagacaatagaagataatatctgaaatgctaaaaacaataaaacaaaaaactatcaacctagaatcctgggcctagaaaaaataatccatatgcatcaaagatgaaggtgaactaagatgagagaatttatttccagcagacctgcattactggaactgttaaagaaaattacttggcagaggagatcacaggaagactgtaaaagtgtgagtgatgaaaaacatttggataaattataatgctgtaacaaagccttgtcttaatttctttgaaagacttttgatttttttgaacagaaacaacattataaggtctaatgcatatagtagtaaaatatgaaaacaggacacaaggaattagagggagaaattgggtgtcataatggcagtgggtatccacagtggcaatggtatacagctgtctctgcagaatcctctccctggcaagaactataactgatgtggccactccagttgtcatttactgacagctcactaggatgcaggtgctcttgtaatgatgtccaccatgcaggtgaggagccccgcccaggaatcagagccctgcaggctgaagcgtgacttccacaggcccttctgcatatctttgatgggagcaggctggtcaggctgagaacccagcactcccctgacttcacaggtgtccccctgactagacaacctcccccaggcgcccactggaccaaaatgtttcctaacagcgctcaatggtgtgattgatacaaaccccacgaggttataaaatagcaggcaaatgtgagatattatcatcactgccaccaccaccagcccggaacattttaattacatttttggaaatattccaattttcctgagggaagaagaaaatcaaaatccccctttttgaccactcatttcaactaatcctaagaaatacagaaagaaaacatgtcaaattccctgctaccctgacagttaacagaatctttgaaaaataaaattgttcttaagcgtttatctaatcagctgaaacgtgagtataaacttccttgtgggcaccccctgcagtagcaactccagaaatacggatgcagggaaagggggctgatcccaagattaggtcaagaaaaacattcccgtggacaaacacaactgctcccaatcaaattcaaagttaacaggtgttcaaaaagctggatttccaatttcagtagagaaatggctccccctaccgaggttttgggagataacggcttctaggcaccagtgggatgctgttaacatatattctattttctgtgactgtcaggtataataatagaatctgtaaggagactgaggcttgagaaggtgaggggcttgcccagtgtctccatgcttggtggtggcggcaccagggaaggctcttcccgtctgttatcccatcccatcctcactgccaacccgaggtcagggtcctaccggcacttccactccatccttgccagccagcagccactcccagcaggccagggccgtctccatgccatgctcattgaacatccggaggggaccccagcacagatgatgaaggagctgcgggtcacaatctggaaccaaacacacgtcagtcagaggcctccaacaacagctgaaccccaaaacagcttccctgggccaacaagagttgaccagctggggccagtgatggccttttattgactttccactcatgagagatactcctctactgggggagctcctgctctttctccggccagtactccagctggctatgggtcatcaaggccagcattcatttagaaacgagcccagaattccacagtgcttcagtgagttacctttactgctaatgagcattgcggtcagcttgaacatggcctgcgtgtagtgctgaggatgactgcggtctaaagctgaatgtagatcctggaccatcattttgttcaggtcagacatctggcctgtggtgcctgagaaccgaatcattccatacacctgcaaaaacattctcatcagcaactaagcatataatccaggcaatgtgggtaaggttctggaagccaccagaccacacttgtggtggcactggtgggtgcctcgctgccccaaagtggagctcatgcatgcagagagacaggctcatttcaatgatgctaccactgatcacagctttttttttttttaaagaacagctcctctagaaatgcatgttggcagtgccaccactgcagatgttccccaagggtgggaaccttgtccctcatcattgtacccagcagtgagcccggggtctgacccatggtgggactgcatgaatgtgagctggataaatacatttcctcaaactcaattaatgactcaaacaacaatatcagcctcattattattttttgagagagggagtctcgctctgatgctcaggttggagtgcagtggcgtgatctcgactcagtgcaacctccgcctcctgggttcaagtgatcctcccacctcagcctcccaagtagctggattacaggcatgcgccaccacgcctggctaatttttctattttagtagagacagggtttcaccatgttggccaggctggtcttgaactcctgacctcaaataatccgcccaccttggcctccctaagtgctgggattacaggcgtgagcggccacacccagccctccttactattattaataattttttctttgagacagagtcttgctctgttgcccaggctggagtgcagtggtgcgatcatagttcactgcatcctcgaactcctgggctcaggtgatcctcctgtctcagcctcccaaagtgctgggattactggcgtgagccactgtgcttggccaacctatctatttttaaagacaaatataacttttttttccagagagaagaacatacaagtgacagagtgctaagaaggagtgaactcccactcagaccaggccactgatagactttcagagtcaccagggagcttagaaatggcatagactaggctgggcgcggtggctcacgcctgtaatcccagcagtttgggaggccgaggcgggcagatcatgaggtcaggagatcaagaccgtcctggctaacacagtgaaaccccgtctccactaaaaatacaaaaaattagccgggcgtggtggtgggtgcctgtagtcccagctactcgggaggctgaggcaggagaatggcgtgaacccaggaggcagagcttgcagtgagccaagattgtgccactgcactccagcctgggcaacagaacgagactctgtctcaaaaacaaaaacaaaaacaaacaaacaaaaagaaatggtatagattagcttctgagtttatggagcaggaaatggaggcccacagatgtgatggcactggtgaggctggaataaactgtggtgtggtgggtgaaagcccacgatgtggagttggaagatgtggttccagaccccactccacttgtgcgactttggcaagttacttaatcttgggaacctccgtttatctataaaactggaataataatacatacatcttaccgagtgcccaagagcctatggcatgtaagtgtttgttactgctgtaaaaaaaagccaaaaaaattaaaaaccttcattcagtgtagccaaagtgtacacagagttaccctcttgtggaaaaaacaagtaactggtcattaacactctggaatgtgccaagaatcctcctaaaatgtgctctttaaatcctcctaaaatatgttaattccacatcaccgggacgctttgttcattttccactaggaagcggccaacaggcctcaaaacaagaggacacgttaaaggccctagggcgcaaggacaagagaagcacctcgcccgcgtagcggttgcgcagattcagggatgccatgaagttggagtagtctttcttcacacaggccgggcgctcgctcagctgagttgcctacagacagataaccattattgtagactatggcagcactatcctttcctcgtgtttaccatggctaagcctaaacccaatgaagcagtcacactcgggtctgggggttactattaataaaaatcttcactgctggcaagttaataaagcaaaatattttagaatacccagcagtttgatatgttccataagaaattaaaaaaaaaagtctctggaaggcagtttctgctactggtaaataggcctttgcaagaaaaagaatcactagattgtgagagcaatgtcacctgtgatggaaacgccatgaaagcattcacagccgtctccttgagagttgcgtgtgcagcttataaatgtcacttacagaccgtaaaggggctgaaggggagagccaaggccagcaggctcttaaacatctgctggctgctcttcagtctaatgggaagagacagaaaagggtacaccttgaatacaaaggcaacccacagaatgggagaaaaatatttgaaaactaccgcccacccactccacccctccagccactctctctgcttcagcctcagcctcccagccccagggcctcagtgacctggcttcctaacccaggctggctgctgtgccacacctttcagttcctgttcatccacggtcactgcagagtacagcatgcattgaaaaggacctcctttcgcatttccctttagcatcagtactaatggggaaagtgagcttctcaactgttttgagtttagagggatttttttttgaggggacatggtgtggagaaagaggaccaggagaagaaaatacagatgttggggaacatcaaaatataaacaagaacaaaaatacatgatttctctcatgaaattattaaactggtttatttaaaaaaataaattacgtgaaactgctttacattttctggaaacaatgcggtctttggcaccaagcaggactgagttagagcttggctctgatactaatcagctgtgagaccttgggaagtcaatgtctctgagcctcaatgtgctcatctgtaaagtgggcataaccctctcacaatgttgttacacgttcaacgtaatgacacacacaatgtcctggcatggcaaacagcacctggtgggcagtgcaggccggctccctcccttccaccatcactcctcactgcccaatgcgatctcggctcactgcagcctccacctccctggttcaagtgattctcctgcctcagcctcccgagtagctgggattacaggtgcatgtcaccacgcctggctaatttttgtatttttactagagatggggtttcatcaaaaaaaaaaaaaaaaaaaagaatttttttttttttttttttgagatggagtcttgctctgttgcccaggctggagtgcagtggcgggatctcggctcactgcaagctccgcctcccgggttcacaccattctcctgcctcagcctcccaagtagctgggactacaggcgcctgccaccatgcccggctaattttttgtatttttagtagagacggggtttcaccgtgttggccaggatggtctcgatccactgacctcgtgatccgcccgccttggcctcccaaagtgctgggattacaggcatgagccaccgtgcctggccccagaattaatttttaaaaattaaaaaaaataacttagagaaaacctaacttacatcaaattttctggggaaaaagaacaaaatattttaggcaaaacagatctttcacaagtcagctggctagagtctagaaaaggcttacaaatgagaacacatattctattttatgtaataaagctttgctcctaccacccccaaaaaggaaaaggcttatgactatcataaacacttacagtctatgagttccgcctctggcctctgtggccacccagtggcagagacgtccaggtcagggcactgatacctggtgccccgtcagagtaggaggcccagggcgggtggccctgcaggtgcaggctggacccagctcaaccatgtctgctagactggtgtctttagagatagtgcagtgacctcgaggagagtgccctgatagcaaaatgaggcgagaagacaccagcattctctggcacatcctcaggccccacaaaagccagagggcactcaggcccctctctcccgccggtatcccaagggaggcctgtcacccttcctcctgggtacacagcctctgcacctccacatatcccatcccatgctccatttggagagagttgggaagcacacatggccaggctctagattcacattaaccaacaaaatctctgaccagccccagtcacatggccaggtggaactgcctgctttaatcctttttaactcttagctctaatttaactcagaaagtattgctgtgtgaaccctctgtcctctagattaatctctagcagaacaagaagctgaaggcattcatgtgcggttcagcacctgcagaaaacagaactgttcaggagtccagtatacgctccagataagtgcaactgtggcatcgcgctgcccgtgtcaggcggagctctgtttccatcctctcagatggggacattcaaatcaaaatctgatcactgacatatcaagcactgatccccataaatccataaatttaaaaaaaaaaaagcacaataaggaaacactcatttcaatggccacctcttctttgggccaaggtgcggcttgcaccactaccattgtcaacagacatccacagcaccctgcatgtactcatgtgcgtcatgaaaagcgacagccgagctctaagccttcccctgcactgtggctcctatggtctaaggggtcactgctcttcagaaggctcgcacataccccaagagttgtgttctgcttgttgtagccagcaaagtgaaggatgctctcagtggccatggccagccccgtgtgctgggacagtcccgatacccagttctgatgtttgttcagatattcctgaaataggaaaaacacatggggtttcagttatttatctgatttttttagaggcagggtctcgctctgtcacccaggctggagtgtggtggcacgatcatggctcattgcagcctcgacctcttagactcaagccatcctcccgcctcagcttcccaagtagctgggactataggggcacgccactatgcctggctaattttgcaattttttttgtagagatggtgtctcactatattgctcaggttggcttgaattcctgggctcaagtgatcctcccgcctcagcatcccaaaatgtcaggattacaggcatgagccactgtgcctggccttgctatttcatttaaaggggaaaataaaactttataaattaaggtgtgggcaaatggaccaaacactgggtttctgtcctgggtctgcccctccctaactagctgtgggactgtcagtaagtcaaagcccctctatgaccagctactgctcatttgactgaggacaaggccaattccccgagcggctgtcatgcagtcactgcggtgttgcaccgtcaatgggagagggccatttattctttcagcacatccttgctgagcatctgctgtggtagccaccaggcaaataagctacaaagccttggccttgcggtcaacaggcaggctgtgtggtgtggagcctcggttctctactgcagcataccagcagcctggtgtgggtgaactggacagcaggaacgaagaacaacacctgtgtccacctggccacccagtgggagaagggtgctgggcaatgggatacctggcagagcccaggggtgtgagggaggcctcctgctctggggaccacagggggctcagcctgcaggagtaccaaggacaagggtctcgagggtgggggcaagcctggaacagatgcaggccctgtttacaggcgtgaaccaactaattcccttaagaagaaatgtacaggagtatatacatgcagaattgtctcaatggttttgggggactcctggagctccagaaacccatccttggacactatgacgatgaagagtgactaataatcaagtttaaaagggaagtacactgaccagataccctattaaaaccagactactctggtgggtggaggagagggcagattcggggaaggctgaggctgggcacggagggtggggaataagcacactgcaggggaagtgaaagggcaggcctggggcacgccaaggggacacctggtggaaaaatcaagaccgcttcaagccttttcattttccatttccttcttaggccagacctgcgtgagaaagtaaaaagctctatcagctgctttttttgtccacttaaactttctaggcattagagggggcctcccctcttcagacgacagacagccttgggacctgaggcccttttgctgtaaatgaacaaagggaaatagtttcttgccactgcgtttccacacagctctcagggctcttggagctggctgctctatccttcctggactccacaaccagaaacacttttgagcctgtttcatctttaaagtgctgccagggtaaacctcacaagagttcctctcagcacacccactctctgctaacacagattccttccagaggtatttttctcatctttgattccttttaaggcaattctttcctctcacaccctgtggcattacatggtttacttcgtggccatctgagtttccaaaccagtgtttttgtctgaaagactcccatgcacctacatgtgcagcttatgtggagctttaatgggacacaagtccccaactctgcctctgctccaccagccttggtcaggcccctgcctttgggcacaggtgccagcaatgcacttggcacttagagatgctgccatctggcagcctcccacatccaccacacaagcccttcctctcgtgagcagcccccaagtcttgccacagacctggcacctcacctggtgtgagccgtcagatgccctccttgtgccctggccagcactggccccacaggcgctcctaacacacagagcagcctctgaggcatctattattctcaggccctagactgatgcttccagtctccattcacactagtgctatttggattttgagttcttcatgtctctgtaaagcttttttgggagtttgaaggagcttatggcaattgccttttgatggtttcaagtacctgcaggtgggacttggtgacggtaggtgcccacttcatggcctcctggaggatcatcccacagcgtgcagcgaagtccttcacaatgctctggaagagggtgaagctgcttctcaacaacccgaggtcagttcatctgagctgccgtagtgactgtcatgggctgaactatgtctccccaaatccctatgctgcgccttaactggtaccagtacctcagagtggaactcatttggagatagggctttaaagaggtgattcaattaaaaggctgatagggtaggtcctgatccaatctggccagtatccttccttacgtgtgtgcagaggaaatctggacacacagaaatactggggcagggaggagggtgtgcacagagggaagaacacgtaaagacacagggagaaggctgccattcacaagccaaggagagaggtctccacagaaaccagctctgccaacactttgattttacacttcggccctcagaactgtaagacaatcaatgtctgtcaagacctttcaagctgcccagtctattgtcttttgctacagaagcccaagagactagcacagccactaagtttgaacctcaaggcccctggggccaggaagcccacacacactatgatctgtatgtaattcctgcacaaggtttgtggcagaatctacaagaataacatgtcacagggacactgtgcaacttgtgtcctgggtctgggactggatggaagggcaggctctgcgtggcaaaatcctcttcggtgccacaccactctgtgggaaactccccattgacagctggtctggcagaggtccagaggtaggacatgactcagcccaggctgaaggagctgtgagctgagttgcagtcttgccacagtgagggctctgagaccgagttggggagaggagagacccagtacatcctcctcttttggagtgatttattctgccagtttccccattggatagcacaagtcaaaggcatgatcccctattaccacaataacaaaatgtcagtgcacctcagagaagtgaagtccacctgaaaatcatgcttgtgcgacgcagactcgagaggctataaactggctggtagctgaagacctctttggcagctaaaccgagaacacagctgagtcaacatggctgaggtgggggagctgggcttggaagacagagcgacctgggggcagccagctccccttgcactcggtggagcctggcaatggcttggtctcctcactgggggatggggccagcaccacccacacctcaaattgctggggactgggtgagctcatgcaggttgaccatctcgtggaaatactcagggaattgtggtaaagatggcccttagtgcaggggatcgtgtcgggcctacctcacgggcttcgtacgtgtcaggaaccgtgatccggtagggggcgtcggggatgtcatagtaaggctgatccttgtgaatatcctgcaagcacagcaagactccctcttccaaactgccttccccaagttgccactagcaaccacatgggccacccctacccaccacctgtctgtctgtgacaggcctccatacttgatgcaacttattgcaaaacaccaggtggatttgggccccctcacccccaactcgacacctgtagcattaattatgttcaggcttattgtcagagaagcatgccacaacacagggcggacagggccggcggggtggtggtagagcgggtggtgtttgggccctaggtctcctggggacactcacagcgctcagtgacagtgacagggtctgcaggatgtccagcatggtcttcagcacagtcccgctccagagcaagtggggaaacctgcaccaagagccagctctcaggaccaagagccaaacctccaaggaaggtctgcttctaggagccccctcagctgccagcccgagcccatatctgcttcaggccagctgaaggaggaggtcgggaggcccttgcagcaggatgcctggcctcctcaggctcattgcagtaaggtgagcaacgcctggtcagaaaggctccccaggcccctgccagccccacttcttagggccagacaaacctgacaccaactgccttggttatgcactggccaggacacccctcactttccaaagcaatcctcttagtttctgaccagggttctccattatttctcacataatggagaaaacaacagtatctacctgacaccctggggtaagacaggccatgggctccgatggccccagggctgaaggagaggtgtctctgcacagctgtgacccaccagtggcccactgctcaggaagcccagctcagacacacgccacgtgtgtgctggactcgttctcgtgacccctggctggctcctgaccacctgtggtggcgctgctgcctggaccaggcacacagtatctgcaacaggctccagaaccactggatacctctggggagctgcaggcagcctccatgtgggtgttttgctgcctctggccttctcaccttggagaagctggtccagcccacctgtgagagttctcatcagtgtggggacatgtcccaacagggtctgttttggctcccagaacaaagagtatacagcacagaagggtctgtgtgggcttttgttcctgagaagcccaaagatactgatcctaccaggggacctctggctgggccctgggctagaagatggtgcaccaggtcatgccagagtgggtgggactgagagacacagggatgtggcacccagcaaatgtgctgtaagtaacatcgatagctcagaatgaacagaagtttctgcaccaaaattcagactctgcaggaaactcacagacattggagggaggctgcatcacccttaggagttttcattctgactccattttttcctagattaataatataaggatgatttttcccagcatttgaaatcacagaagtttatatacatacacacaaaacattagcaggaaaatgagcttacttatccaccagaccagatagatacttgtctgccaccctccttatcctcttgtggatgtggttgaagttcaccaacaggaactgagcgtgccgctccagctcctcctcgttctccttggtcttggcctagagatgcaaaagaaacaggtaccgcagtgccccagatgcctccagcagacagacacgcattcatgctggagaggcttactttatccgccatcatgttcaggaaggcatcgaatactttgtccgcgactgcaatcacacactgcatcatccctgaaacgagaaggtttccatggataaggtgcagcaacagagagagaatcctagcaactttcaatcattttcttttgaaatgattttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctgtgtctcctactcctgtccaatatgtggtgactcctcagtctgtcaatgtcttttgtgactttgacacttttgaagaacagttattttgttgaatgtcccctaatttaggtttgtctgatgcttgtccatgataagactagggttacaggatttgagggagaactccatagagtggatgtgccctttcttttttctttctcttttttttgagattgaatctcgttctgttgcccaggctggagtgtggtggcgcgatcttggctcactgcaacctccgcctcctgggttcacgccattctcctgcctcagcctcctgagcagctgagactacaggtgcccaccaccacgcccggctaattttttgtatttttagtagagacagggtttcaccacgttggccaggatggtcttgatctcctgacatcgtgatccgcccgcctcggcctcccaaagtgctgggattacaggcgtgagccaccgtgtccggcctggatgtgctctttctgcatcacgtaagtggtatgtgataacagtatctcttattactggtgaagctaaccttgatcccttggtttgagttaccgtttttccctttttctattttttttgagacagggtctcactttgttgcccagtctggagtgcaatggtgagatcatagctcagctgcaaccttgatctcccaggctcaagggatcctcccacctcagcctccctggtggctgggattacagatgtacaacaccatgctcagctaattgattattttttgtagagactgggagtctcactatgtagcccaggctggtcttgaactcctgggtcaagcaatccttctgcctcggcctcctaaagtgctaggattacaggcgtgagccactatgcccagtccctttctctattctttagaagcaagtcactaaggacagcccacactcagagccaaggaattaaatgctacctcctgaaggaaatttgtgaatgagaattacagccaccacagcgattgatattttggggaagatactttgaagttatgcagagatcatgtcttttaagattttgccccttcactttggcatccacgagtgaattctgcctgcagtagttactgtggttgtcataggaattttctatttccctcaattctttctactttttaaaaaatgttggccaggcatggtggctcacgcccataatcccagcactttgagaggccgaggtgggtggatcacgaggtcaggagttcgagaccagcctggccaacatggtgaaaccccatctttactaaaaatacaaaaattagccaggcatggtagcgtgccactgtaatcccagctacttgggaggctgaggcaggagaatcgcttgaccccaggagacagaggttgcagtgagctgagatcatgccactgcactccagcctgggtgacagagcgagactccatctcaaacaaaacaaaaatttattttttagggacagggtatcgctttgttgcctaggctggtcttgaactcctgggctcaagcaatcctcctgccttggcctcccaaaatgctaggattacaggcatgagccaccgtgcccagcctcttctatttttattaatagtaactggaattctgtaaggaaggttcagcctttttccccattttttatttattcggtagtctaatcattacagaaccgtggatgtttattcgttgggttataatccaataccatttattctattcaaatcattccagctttggccactcggagctctttcaggttggctcctgtgtcattcggacaggccccatgtcttgtcttttcttcttctttcttggcgtgtccttactttctggtgtaacaaggtgccccaggctcatcctgtacaggcctccctagaatcaaccatttctccatggagccctggttccttttattggagaatactatttagaaaccaagatctgagcaccggatatgctcattgttacagaggtgccaagtaggctgtaaaaggcaacagaatgggctgggcacagtggctcatgcctgtaatcccagcattttgggaggctgaggcgggtggatcacttgaggtcaggagtttgagaccagcctggccaacatggtgaaaccccgtctctactaaaaatacaaaaattagctgggcacggtggtgcacacctgttaattccagctacttgggaggctggggcatgagaatcacttgagcctgggaggtagaggttgcagggagctgagattgtgccactgcactctaggctgggtgacagagcgacacactgtcacataaaaaaaaaaaaaagaaaagaaaaagaaaaaaagcaacagaacacagtgatcatcacagtgcagatgaagaaactgtaataaaatgccaattcacactccataatgctgtttctctatccagtgtttttaatttgcatgactacatgctgggtctgccctctgcctccaggcagagagacaaggcaggtgctatcagcttggcacctcacacccagcatgaagcctgagacataaagaggcctttcatagctatctgttataagggtaagtgggaccgcagcaatttgaaaagttatcagtgtgacctggacagatgctcaagggtagtgagaggctgctttcttaagaggctgggttgggtgggtgaaatcttattttgggccatgtgtttagtataatagcttttttttttttttttaattttttgagacagagtttcgctcatcgcccaggctggagcgcagtggtgcgatctcagctcactgcaacctccgacgggttgcattcccagattcaagcaattctcctgtctcagcctcccgagtaggtgggattacaggcatgcgccaccatgcagggctaattttgtattttcagtagagatggggtttctccgtgttggtcaggctggtctcaaactcctgatctcaaatgatccacccgccttggcctcccaaagtgctgggattacaggcgtgagccaccacacctggcctagtataatagttttttcatatagttctttggaaactgaaactgtaaattcctgataatcagatagacatcagatgccaatcaatgtcatgtagtagcatctaaggagattaaaaaaaattttttttttgagacgtagtcttgctctgttgcccaggctggagcgcagtggtgtgatcttggctcactccaacctctgcctcccaggttcaagtgattctcctgcctcagcttcccaagtagctgggattacagtcacctgccatcacacccagctaatttttgtatttttagtagagatgggtttcatcatgttggccaggctggtctcaaactcctgacctcaagtgatctgcccacctcggctcccaaagtgctgagattacaggtgtgagctaccacacccggccctaaggtaagtaagatttttactttaaaaaggccactctcctcttaaccccttagtttagctctggattactggtgaactgactcacaggatggtgggcaggtgagcagcaggctcctgccctcacgttcctgtgcagctgagaacataacagaggctcatcttatacctgcagagaggaggcagaagtccccactttagtggggctgctagatatttcatataccctctcctcctggtaggttctgaaaattcaagaataatatatgtctccaaagacatttccttcttatctttcatgttttagaggaaaaatataagagggatatacactcaatagctgtacatttactggctaagtgccacgctcagaacaaaaataatcagtttgaaaccatgtggaagagtacaatgtactgcaaaaatgaaaatcgctttattttgaattaaggtgaggaggaacaatcagtcccccggaacaatttaacgtcctctgatgtcacaggaacagaaaaacagagctcagagagaagggcgaatgagacatctcacttcagaaagggatctgattcggtttatgaatattctctagaaggctggcaaaatctgctaggttctccttcctttttttttttgagatggagtttcactctgtctcccaggctggagtgtgtggtgtgatctcagctcactgcaacctctgcctcccaggttcaagtgattctcctgccttggcctcccaagtagccaggactacaggcacacgccaccgcacctggctaatttttgtatttttagtagagatggggtttcatcatgttggccaggctggtctcgaactcctgacatcaagtgatccacccacttcagcctcccagagtgctgggattacaggcgtgagctaccgcacccagcctttttcttcctttttttgtctcctcaggtcttgtctgaataatgtgctaggtgcttaattcttctagaggttggcagtttcaattttgttgttgcttagtctctctcctagaaccaaagaatcgcagggtgggccaattgtctagcacaagcttttccaatctgcagtccacacacagcccaggatggctttcaatgtggcccaacacaaatttgtaaacttaaacattatgagattctgggccgggcgcagtggctcatgcctgtaatccctgcactttgggaggccgaggcgggcggatcacgaggtcaggagatcgagaccattctggctaacacagtgaaaccccgtctctactaaaaatacaaaaaattagccaggcgtggtggtgggcgcctgtagtcccagctacttgggaggctgaggcaggagaatggcatgaacctgggaggcggagcttgcagtcagctgagatcgttccactgcactccagcttgggcaacagagcaagactctgtctcaaaaaaaaaaaaaaaaaaaaaaaaacatgagattctgtgtcttaaatgtcttaaaatattataagattttttgtgtgtgatttttctttcttttcttttttttttttttttttgctcattagctatcgttagtgttagtatgttttatgtgtggcccaagacaattctttttcttccaatgtggctcaaggaagccaaaaaattggacacccctggtctagcacaaaacttagcacaaaatctgctactacatggacaaatgcaaggtggacggatgaggggaacagatcaatgaacagttcagccagagcttgacagcatctctcttatagccccaactggtcctggggcatgtgtgtgagactctctgaatgtggcccccaccccgccctgtgtctacatcccctctggaagaggcttctctgtagaaactgcctgcctgcacctcccatccctggcctcaaatgggctccttgctcactccaatcccctccttactgccagaagggggagcttccagaaccctcacagtctttccttgccaactccactggctcccagctgcaaaaataaattcatgcacctgacttcctgactgttgtacagcagtgtgaagtgctccacaaaggacttactagaagagtcttacctgaagcagtatctcagagcccctggggcatttttttgtttgtttgttttttaagagacagggtcttgctccgtcacctaggctggagtgcagtggtgcgatcctggctcacttcaaccttgaactgggctcaagggatccccctgcctcagcccccagactagctaggacgacaggcatgttccaccatgcccagctaattatattttttgtacagatggggtattgctatgtagcccaggctggtcttaaactcctggcctcaagtaatccacttgggttggcctcccaaagtattgggattacaggcgtaagccactgcacctggcctggggtgatttttaaaaaacatttcttgaagcgttgatttttctttttcttttcttttctttttttttttttttttttttgagacagagtctctctgtcacccaggatggagtgctgaggcacgatctcggctcacctcaacctccgtctcccaggttcaagcaattctcctgcctcagcctccccagcagctgggactacaggcgtgcaccaccacgctcggcttatttatttatttttgagacagagtctcactctgtcaccaaggctggagtacagttgcgtgaactccactcactgcaagctccacctcccgggttcatgccattctcctgtctcagcctcccgagtagctgggactacaggcgcaggccaccacgcccggctaattttttgtatttttagtagagacagggtttcaccgtgttagccaggacggtcttgatctcctgaccttgtgatctgcctgcctcggcctctcaaagtgctgggattacaagtgtgagtcaccgcacccagccaatttttttatttttagtagagacggggtttcaccatgttggccaggctggtctcaaactcctgacctcaggtgatctacctgcctcagcttcccaaagtgctgggattacagctgtgagccactgtgcccagcctgatttttcaacaaaagaaaaaatggtacaagaagtatcggaaataatttctccataagcaagaacaagttgatagattcaccaacctatcaaaggcttctggtgcggaaaggactacacactgttagttgtacttcattaatactaaatttgtcaatctcaagaatttatcaataagcatgcctcaaagaatttattcatacagttaatcaaaatttgtggattctccccaattcccttgcatatttaaacatgatttcatcataattacaaaaattatcaaattattctaagcatttaattaaaacttaggtctaacatttcagcatattttaaatttttgattttaaacaccttataaatcagacttcttagtgcccttacactaaaactggccaaaaagtgcttatacgcagcatttaactttttcctttgttgtctctattttaatatctttttattggctaaatacacttttgtaaaactaatattagccttttgcaatttaaaaaaattaaggtataatttgcatataataaaatccacaggtcttatgtgctcaattccatgacttaacaactgtacacactcacgggaccactacccaaacaatctagaggacacttccatcaatccagagggtctcctggtaaccttcccagtttccatctctcctttttattcttatcttagctttgtcttcatagggttttgatcattgtaacatttttatgccttcctacagtttccaccatttctctgtcttcccaggagttggtctcctgggctagggctggtaacagctgaggccctctgtgcactcagggtctgacgacaagttgcatctggaagcaagtggcatgatcatagctcactgcaatcttgaactcctgggctcaagcgatcctcccactcagcctcccaagtaacttgggactacaggcacaaactactgtttcctgctcctgacgtttaaaaaccatgactgctctctggcaacagcaagttgctgcaggtccatcagtgcccatccgaggagccctggtccctctagatgagtgctggagcacacttgagcatagatagtgggctagaatgaccatccttctgttcggggcccttgcaccagcagtagaaccattaaggcgtatatttgaaggctatatgttttatactgatctttctcatgcaatatttaacttcataaaacattttctacatgtagacagaaaagaggaagtagtacgcctttttaccctattaaagctcaattcatcatgaaagcaccataataatgagcttaccagatttgtctttctgaatagctttatcctcaaagtagcagaacattacctggaagcgatcaggatctgttgaacgcagtaccctaagaagaaaacagctttaaataaattttgaaaaatctgggccctccctatcacagatttgacactgcccataagtggtaaggatgtgaagaacatttgccctctgtcattcataagggtgcacactgaggtggactttttggagggtgaggtgcaccatctattatacattcccatatttttcactccagcagccccaccattaggatatatcttcagggttacatgcacaaggattctcctaacagcactgactgcattatccaaaatggaaagactctgaatgctcaccaacaggagactgggcagataagccaaagcatacccattcgatgacacatcatgcagccaccaaacgagaggcagctctctatgtgagctgttacaaaaaaagtctgagacatactattaacagaaaaaaggaaggtgcagggaacacatgtccagcatgaccccacttacaggtttcctaaaggtctgtctttgcatgtgtatgtgtaggctatgcatgcttgcctatgcacagaaaatttctagaggaaaattaagaggccattaacagtaggatagtagaaatgaagtattcacgtctacaaaagtgatacctgtattttttcatctttagtatcttctgtactattccagtgttttctcttctcttttttgttttatgcactctgtacatttttcttttatggtaaaaaaaatatctttaacctcagggggaaagggagaaaaaggaaaaagcgcatgcacttgtcccatgggtgctgtgaagggctgttcagagttccaggggctccactaaggcagcagcggctcggcaggccatgtcttttggcctctgcaccaacctgtcaagagttaagcctcaggagggcaggccaggtgactttcagcacacgcattcgagtgtgcacgtgcacacacctttaacttgatttcccaaattctccactttgtggttttaaagctctctcaatacccagtggctgggaacctgagccaggttcctgaataaaggctttgaggttgcctctctatgctaacagagtgctctcaagggcctggtaggcagcccgaggtggaaggtgggctcacaggagctgctatgggctgcgtcttagagtcttcctctgccagttaagagcccgtcctgagaacctgagaaaactactcaggggcatactcatgggaaaggcagaggtagctctgccttcaaaccacatgaggttgagagggtctggagatacctcttctagccgtacatgctgggatgaaagccatgtttttgctctgtttgggtctggcttgttttgttttggctgttttttctttgaaaatacattgtttagaaaaaagactacaaacagctatactaacaggctataggggatgacagtgaggtcagtgttttttctctctctacttattttgcaagattttgtataaatgttttgtttttataagacagggtcttttgcccaggctagagtgcagtggtttgatcatagctcactgcagcctcaacctcctaggcttaagcaacccccttgcctcagtctcctgagtagctgggactacaggcatgtgccaccacaactggctaggtttttttgcttttttttttggggggggggggggttagagacaagttcttgctctgttgcagaagctcaaaacttccgggctcaagtgatcctcccacccctcaaaatgctgggattagccatttgtttttttgagacagagtctcactctgtcgcccaggctgcagtgcagtggcaccatcttggctcactgcaacctccacctcctgggtcaagcaattctcctgcctcagcctcctcagtagctgggactacaggcatgcaccaccacatccagctaatttttatatttttagtagagacggggtttcaccatgttggtcagactggtctcgaactcctgacctcaggatctgcctgcctcggcctcccaaagtgttgggatgacaggagtgagccactgcaaccggccgtgcctagccatttttgtgcaatgttctttttttctttttttttttttgagacggagtctcgctctgtcgcccaggctggagtgcagtggcgcgatctcagctcactacaagctccacctcctgggttcatgccattctcctgcctcagcctcctgagtagctgggactataggcacccgccaccacatctggctaatttttgtatttttagtagagatggggtttcaccacgttggccaggctggtctcgaactactggcctcaggtgatccactcgccttggcctcctaaagtgctggggttacaggtgtgagccaccacatccagccaaaataaaagacacttacaatgaaaaaagaacaaagtcaacactcccttggctctgtgggacttggggagaatgcgtcactgatttccacatttggctgtgtgtggagccccgggctgagggcagggaggaggagactgagcaggagggtagggtgcattcccatgcaaccaaagcactctgcctttcttttatgtattgagctttcaaggactattttactagagggttggtggcaacaatgaaaggctaaaatagtgttttccaaatagcctttctctcaggaacactttctttttcaaatcatttgggaaagaaattattctacgacttatttgcatccctcccgacttaagctgagtgtaatttgaccttttcttgacaacaggaatcatcattttgtagccaatgtactcagctgctgtcccagggcgcctgaggcctcagcacagtgggtctgtatagcactgcctacctcacaagcatgtcggggagtgcgtaaacatgtgtaatgcagcacagtacctggtacagcacagacactcaatccaagcttacttctgaggtcaacatgataacagctgtagatcctaagtgtcactaccactgttaggactgctgtggccacagatgtgtcctgagcatcgggccacatgcaggactgttttggagccggccccaccccatgtcgcatttgctgtttgtactcaaccatggtcctgggaaacagctcagtgagtgtcctagacacgcactcagcgaggctgggtcctcagaagggcctcgctcagtccgtgggctgagttcacaacactgactgcaactgctcagaagcctgtttcctatcagagagaagatgatgcggagcttagatactgggaggtgttactatacgtggtgtctggtggtcatgaaggaggggcatacgagaaaagtagagggtgtttttgcttggtttttcagaaagtttgcatgtcttgggagaagttgaaaaaagtctcatgcttacgagggcacaaaaatgaaaaccctgctcaaatgtggatgtgcatgtgcatggtggtgaaggcacgtgtacctcatgtactccagccggtacacagagaggaggtaggtggacatggcgaagtccagcttgttgatgagtgcggacacctcgggaggggggtccagcaggttgatgatagtgctgcggagctcactcagctcagcctggagggagagaaacatccgagggctcatggggcatcccccaggacaaacaggtcccagtggctggcaacatgtgttaataatgacagtgaaaagatctgccctaattggcacagagagcatggtaaaaatgagatgtgaatccttacgggggtgaccgtgtcattcttcatggctgagttatactggaggacggaccgcagtggctccttgctgggaaaggtgagcaagggggacttagtggctatttcacagaccccctcgtaccattcttctggccagagtcctgcaataaagtgaacataaatgaggaaatcaccttggtcggaaagcactgcagtgaggttgactgacaatttctatagtcatgggtcctttgagacaattatcccaaaaactaggcacagaaacgaagtctgttacctgacttggacagacttttcctaaggtgtatggcattctcagcaccctaaactacatctggggacagtaacacttgctaatacttgcagaaagaagcagctgcatgtggactcatttaaacatgctcacattcataattacgtgggctctgacctcacctttaccttcactctgcactccgtcttcactgggagagagatgatccccctacctgagccctccacagcgaatcccatcagaacggaatacagccagaagtctcggaagagcttctgtaaccgaggcttagcttctttgatgggtggcagtcgtcgggtgagctgatgtgccaagaagagagggagaaaggaggttatttgctgaggaaaccctaagccctgtaggtgtaaaatcaaccacagattcattctctaagagcattctcagaaactcagactgggtaggaaaaggcacactgagcagtgatgattctgccaataagcattgtccatccactcatttactgagtccctagtgtgcaccaggtgctgtgccagggaggaaaaagccctgttcctgcacttgaaggacttcctgtctagtttggaggcaggtgagcaacagttacagtggggtggagttcccagagaaagtgtcatgggtctcagagttaacatttgaggaaaacttagccaggaaagaagagaaggcagcctgtccagccacaagagcattaggtcctaagcctggcactgtggagggtaacaaatgctcaggaaaggcaaacaatggatgcgagccagagcttgaggaagggatgccactggggaggcagggagagcacaagaactctcatgggccaggcagcacaaattttccaaacagtaatcttcggcagaatccccatatatgtaacaggtaaagcagagttgcttgggtgcaggtgaggggctattgtccttgtgttcctgctccaaatgctggggggaggcagggagagactcatcagtggtataaatggctaaacttggccaagcacggtggctcacgcctgtaatcccaacactttgggaggccgaggtgggcagatcacctgaggtcaggagttcaagaccagcctggccaacatggtgaaaccccatctctactaaaaatacaaaaaattagctgggcgtggtggcaggcacctgtaatcccagctactcgggagattgaggcaggagaactgcttgaacccaggagacagaggttgcagtgagccaagatcgcaccattgcactccagcctgggcaacaagggcgaaactccatctcaaaaaaccaaaaggtttaacttgtgcacgatgcccagctggacaggctgatccttacggaccccccagtggatgttgagctcccatcagtgatgttgagcctgtggtaagcgggggctttgctacccccaaacacttatgagcacctggtatgggccaggcactgggccgggagagaggtgggagagatgaagacaccatctcttgaggcaaggagggcacaatgggatgggctgtgacacatcatgcacagcaggcaggactgtaaactgtcacaacacttctttgaaagcaatttggtaatatgcatcagaaattctaaatatccccacatatttcacccaaaatcccatccctgagaaatctatccaaaaaatgttaaaaagctgatttaggcacaaaaatgttgcaacagcaaaataaatagaaacacactagatgtctacctgaaagggacatttaaataagtaatggtatattaaaagtataataaattggccgggcacagtggctcttgcctgtaatcccagcactttgggaggccgaggcaggtggatcacgaggtcaggagatcaagaccattctggctaacagggtgaaaccctgtctctactaaaaaatacaaaaacattagccgggcgtggtggcaggcgcctatagtcccagctactcaggaggctgaggcaggagaatggcgtgaacctgggaggttgagcttgcagtgagccaagatggcgctactgcactctagcctgggcgacagagcaagactctgtctcaaaaaaaaaaaaagtataataaattaattatttttgagatagggtctcactctgttacccaggctggagtgcagtggcacaatcatcactgcagcactgacctcgatctcccaggctcaagtgatcctcccacctcagccttcccagtagcagggaggacaggtgtgctccaccatgtccagctaattattattttatttatactttttgagatggagtcttgctctgtcgcccaggctggagtgccgaggcacaacctcagctcactgcaacctttgcctcccaggttaaagcaattctcctgcctcagcctcctgagtagctgggactacgggcatgcaccactatgctcagctaatttttgtatttttagtagagatgcggtttcaccatgttggccaggctggtctcaaactcctgacctcaagtgatctgcccgcctcagcctcctaaagtcctgggattacaggtgtgagccaccacacctggcctaattattattattattattattattattattattattattatttccaattcaaaaattttaatttaaaagtaaactttaatgtcaaaaatgcaaacttggggaggggagaaagatcacacgcaaagctgccacttcacacttgcagggctgcacggcagctaggcaaaggtgttcctcaattcccagacggtgcggcggccagacagaggtgctacttactcacttcccagatggggtggtggccaatgcccggcttaattattgtttttctttttttcatacaaacagacaccttactgactttttacatttttttgtagagaaaggctctcactatgttgcccagggtggtattaaactcctaggttcaagagatcctcccgtgttggcctccccaagtgttggaattacaggcgtgagccaccacactcagccaagaatcatattttctaagactatttggtgacacatgtagaactcacaatatgtcaagagaaaaaaatccaaaacgtataaataatatgatatagattttaaaaaatctaaatatatacatatagaacaaagatgggaaaaagcagccacatgttaagattatttctgggttgctagggatttcactcttcttctttaatgtctatatttcctggagctcttccatcaacatgttccttttacaatcaaagggagggtgcaggtgccggtccagggcttggcaacctgtgtggaagaaggctccacacctctgcttgagagccgccagggcactgtgtccttgggaagagtgggccaagacctgggggtgcagggcaggctctgggtaggtgctgaggaggtggggcactttggagagggctgtgtggagggcagcagcagacggaagcgacacagggcaggaaatctagagccacacaggatgtggccacaaaaggacagttgacaaggggcttccagttcagctagtggccaaggacagtgacagtaagaacacgcaactgtgggactgactgtctctgaagtgaccggcctcccaggataaggtcccaagtgatggtggagatatgaaggggtttccagactacagaattcaaggcctatgtggctaagaggttctggtaccttctaaagagaactagactttggtggttatggaaagggttgcgcttctagaatgcttccctctcaatgagaacagtagctccacgtggctgggaagttcaaagtggttttgacacagaaaagaggaagtaagtggactctatctttgatttgggatcctactcctgaccctgtgaacttcttggctccctcttgaggacgttggcttgaaagtggctctgtgggttctccctgctctctgacttctccgagcctgctggccactgtcttggctgagactgctctagtctccagaaaggagatctgctcactcctaagaagtatcaaggtcaggccaggtgtggtggctcacgcctgtaatcccagcactttgggaggccaagacaggcagatcaggaggtcaggagatcgagatcagcctggctaacacggtaaaaccccatctctactaaaaatacaaaaaattagccaggcgtggtggcacacacctgtagtcccaggtactcgggaggctgaagcaggagaatcgcttgaaaccaggaggccgaggttgcagtgagccaagattgcgccactgcactgcagcctgggcgacagagcgagacgccatttcaaaaaaaaaaaaaaatcaaggtcaggggggaagtgggaagactgaaatagataaaggattctaaagagatataacagtcaaatgcgacacatgaaaccctgaccagataaaaattaaaaacccataaaatacatgtttgaagtcatagagtaatctgacttggactagacatgtgatatatgtgaggcttgtgatcttcccaggagtgatggtagcacagcacagggcagagacccgtccatggaagaaacactggtgctagtgcccagggcagaagtgagtgatgtctttaagtggatatggaaaaatattaactattctacctaggttgtgggtgtatggatatttagtattcaattattccaatttctctgtgtatgtatacatattttttttagagacagggtctcactctgtcgaccacactggagtagggggtacaatcatagctcactgtacatactcaagtgatccttctgcctcagcctcctgagcagatgggactacaggtgtgcagcatcatggcccagtttttttttttttggtagagatgggttttgctagccgggagcagtggctcatgcctgtaatcctagcactttgggaggctgaggcgggcagatcatctgaggtcaggagttcaagaccagcctgggcaacatggtaaaaccctgtctctactaaaaacacaaaaattagccaggcatgatggcaggcgcctgtaatcccagctacttgggaggctgaggcaggagaatcgcttgaacccaggaggcagaggttgcagcaagctaagattgagccactgcactccagcctgggcaacagagcaaaaactccgtctcaaaaaaaaaaaaaaaaaaagagagagagagagatcggttttgctatgttgcccaagctggacacggacacacacacacacacacacacacacacacacacacacacacacacacacacaagctggacacagagacacacacagtgacagggcaaaggttccaaaattttaaacctggtaaatctgggtacgggtatacaggagttgttctactacactattctttcaacttttttgaaagtttgaagttatttcaaaagaaaaagttttccaaactttagtgatcctcctgcctcagcctcccaaagtgctgggatgataggcatgagccaccgtgcctgacccctctgtatatttttagaatttcatgttaaaagatggaaaagtctggatgaggtagttcacgcctgtcttcccagctctttgggaggccaaggtgggaagactgcttgaagccagacgttcaagaccaacttggccaacatagtgagaccccgcttttttctaactaaaaaaatttttttccaagttggaaaaaatatctagccataagacaaaccttgaaactgcaaaagaacaatggagtatgtgtgacaggaggtactgctctacagtggggttaaagccatacacaagctgtggtggctcacgcctgtaatcccagcactttgggaggccgatgcgggcggatcatgaggttaggagttcaagaccagcctggccagcatggtgaaacccgtctctactaaaaatacaaaacattagccagacgtggtggtgggcacctgtagtcccagctactagggaggctgaggcaggagaatggcgtgaacccaggaggcggagcttgcagtgagctgagattgcgccactgcactccagcctgggcgacagagcgagactctgtctcaaaaaaaaaaaagccatacacaagctgttaccactaaatgggaaaatgactgaaaaatgtcaatgtcaagagggactgaaatcaaatttttccaatagtgggttacatgatcagaaatccaaatagacaggaaatatgttggctttatttatttatttatttatttatttatttatttagacagagtctcactctgtcacccaggctggagtacagtggcatgaactcggctcactgcaaccttcacctcccaggttcaagcgattgtcctgcctcagcctcccgagtagctgggactacagatgtgtgccaccacacccagctaatttttgtatttttagtagggacggggttttaccatgttggtcaggctggtcttgaactcctgacctcaagtgatccacccgccttggcctctcaaagtgctgggattacaggtgtgagccaccacacctggccggtactggctttaaaaataacaaaagtaatacatacacatagaaaaaggtcaaacaaagaagtacatagaatgaaaaatgaatgctgtgtcccctcccagaccatttctgtgaataaatatgtaataccatgaaatgatgaggactaacattttctgaatgccaggcaccactctatgtgctttccacacattcattaacctcatttaattttctcatttaattaatgagataaattaatgtatctcatttaattttcacaacaacctcatgcagtaggtgtaactgtcaccctcatttcagagagcagaatactgagagctggaggccaaggggcaatttcagccagggtggctggtgacgcctcggtgaaaccaagagcgaacagtgagagcagcggccacctgctggtctgcagggatggtgtcctgggcagaaagaatagcaagtgccagggctgtgctggggccgggctttgcatgtgtgagaacaagacagagaatgagggaggtgggcccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccaccggtctgtgtcctgaacacaatggacctttacactctggaatttctcaaacggagcaatgcacagacacccccatgggccccttgcacacccgcagattctcctaggagtcacattctctcttcagatagactctgggtgccgacactcccaaacatgctcttgaggagcagtctctgtgataagctgatcttccagacaatccagaatattcttaaaactttttagatcataaaatttaaaacacaaattaaaaaacaaattatcataaggccgggcacagtgactcatgcctgtaatcccagcactttgcaaggctgaagcaggaggatcacttgagcccaagagttcaagaccagcctaggcaacatagtgagaccctgtctctacaaaaaagtcaaaagttagctagacatggtggtgtgcacctgtattcccagctacttgcagggctgaggtgaggaggattgcttcagctcgggaggttgaggctgcagtgagccaagatcacgccactgcactccagcctgggtaacagagtgagaccctgtctcaaaaaacacatagggccaggcgtggtggctcacgcatgtaatcccagcactttgggaggccgagacgggaggatcacttcactccaggagttcaacaccagcctggccaacatagtgaaaccccgtctctactaaaaatacaaaaaattagttggacatggtggtgtgcgcctgtaatctcagccactcaggaggctgaggcaggagaacgcttgaacttgggagacagaggttgcagtgagctgagatcgcaccactgcactccagcatgggcagcagcgcgaaactctgtctcaaaacaaacaaacaaacaaacaaacacccataaacacaaaatgtatcacagcctcagagatccccacgaatgcctaagtggccctgaatttgggaggcactgctcagtaatagtcctatctgtcccacaacagacaggagtgctgggctgcacctactggcaacaaacacagcaacccttgactgaagaaaggtccatgccacaatccccttattctgtaagccactaattttgtcctctctcctccacctttcactgaggaacgagctcttggaaggacagggacacccgcctagtagctgagccagccacatcagtcctggagagcaggtggagggcagatgctgtgatcatcccagaagagaggacacagttggaggcagatgcatggtctctactttcagctaccctcaatgcagcctggtccccagaggcctgaagagcgccttgtttatgtggtgacctcaagaggggctgctcctgcaccaaggctatgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcagtgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggctgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacaaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaaaagacagaaagaaaaaatagccaggcgtggcatgtgcttgtagtccaagctactggggagggaggctgaggcagaaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgtatctgttataattctctattttttgaagctcaaatatcaaaagccaaatccaaattcctggataactccaggtatgataaaggctgagaggaagtcacttgagcaccacaatgtgccacagcagggcatgttctcaggacaggacaggtgtgtgctgaatcctggggagggtctgtgcagtaccccagaactgtggggtgctaagtggcacacaagccccagggctcccacagtctatgccaggctgctgcagctttcatccctcatacctggtcctgcagtgggtctggtttgacagagcagatgacacctgaggaatatgtttctggatccttcaatccctgggtaagacaagtgaaatccacagaggctgttcagcacgcaagagtgccagtgctctttcagtgaggggatgactgacggtcacaggtgctgtgtgtgcaggtgtctaactgtaacccccacagcctggcagatgaggaagacaagggttggaagagttctgaaacctgtccaagatgctgaagtagtggggctgggttcaagtgcaggttggctggactccagggaccacacaaggagtcctgtcacaggcttctgaccccatgagaccaataccagtaagaagagtggtaaaagggagtagggacggaaggggaacgtcactgccctttgtaggcatgcctgtgggttatctcacagagtctccttaccctcaatccctagggggctggcactgttacccctcctttttacagctgcagaagcaatttcagctcacagaagggaaggcctctgcctgaggcctgaatccacacccaggcagggggaccctgcagccctgctttcccctgctcccttcctgacttcccacactgggctctgcctccttactctgctgagagcagatggtgcaggggctggatgaattgccccaagccatcctctcggcttcctggtgaaccctgatgctgcggatggcccactccttcaattcattctccaatctgcttcacccctcttcttttctgtcattctccaaactgcttcaccactcttcttttctgtcattctccaacctgcttcaccactcttcttttctggtgcctgtcctatatttctcatcttgctgcagcttccttttggctcttctcatttctaaatgtaataatctcaaaaaacccttttagtcctttgccatgtctgtcccatacccagaaaggcagtggtcacttctgctcacccagcgccctctctgctacagccggtgtggagtcctccacactcttgagcatccagacacccccgtttcaatgccttttgttcatgtacacccactcagaatctctcagatcccctcttacagaaactagcccatctgttactcaaagcaggagagtactcattcagaacacaggctctgagccaggctgcctggtttgaatcctggctctgccatctagtagctatgaaactctagtagcaggttctgtgcctcagtatcctcatctgtaaaatggggagaccagcagcacttaccttgagggattgctgtgaggattaatcaaattaatgtctagaaagcatttatttatttatttatttattcatttattttatttttttgagacggagtctcgctctgttgcccaggctggagtgcaatggcacaatcctggctcactgcaacctccgcctcctgggttcaagcaattctcctgcctaagcctcccgagtagctgggactacaggcacgtgccaccacgcttggctaatttttgtatttttagcagagatgaggtttcaccatgttggacaggctggtctcgaactcctgacctcaggtgatctgcccaccttggcctcccaaagtgttgggattacaggtgtaagccaccatgcctggtctggaaagcatttagatcactgcttggttttagcaagaactaggaaaggttgtcacattattctcaatctaagagagtacataagccaggccttcttaactggggagccttgggtagattgcttccatttaacttcctgaggttacatgcaaaatcttgagagtaataaggatttccatggacagagagtgcacagttttcgaaaaggttctctgtgacctaaaacatgttaatccacacacacctggttttgcaggcactgagaaaataagtaaaccttccaaggccacaaaagtgactggtgacacaagtaaacttgctctcagtgaaatacatgaatgtttttccagaaggaggtgcatcttattaaatcactattatatgacagtggaacaactaagtctctaagcattagataccattcaaaacgtttaactaacaagctaagtaacaactgaagtaatttaatcaatgatatctctgaagaaatattattcacaaagttgcggtacaaagatcaccaaatctagccaggaaggagcctcagagattgtatgacccagcttcctagcaactccctcaaagtcactgagaacagctgcattagggccaaaacccaggcttcctgccccaaatccactggtacttccattcaacagagtaatctgagacactgtgtcatcaaaggtcacagaatatactctatatacaaaatagagtatatctttcttttaaaaaataaaataagtaggccaggagtggtggctcacacctgtaatcccagcactttgggaggctgaggcaggtggatcacttgaaaccaggagtttgagaccagcctggtgaacatggcaaaaactgatttctactaaaaatacaaaaattagccgtgcatggtggtgcacacctgtaattccagctgcttggaaggctgaggcaggagaatagcttgaacccaggagatggaagttgcagtgagccaaaatcacgccactgcactccagtctgggtgacagagtgagactctgtctcaaaaataaaaataaaaataaaaaaatttaaaaaaaacaaacacacacacacacacacacacacacacacacacacacacacaacaaaaaaaaccacctctggaaattagtttcttccagaaggtccaaggggtaaccataaagtaaatgcaaggacccatgatctctgtgctctttgttgagcaataaaatcaaatatttgtttcctcctccataatataaccattaactttcactaaaaatacacttattcttctcatgtaagaggtcacatcaggggagtatttaaatgagcatgtgctaagctatcacagataacagttctgcctgtaccacccaccccagcagcccggagaggcgcaggctcacacacgatcccacatgtaggaccaggagtccaacctggaaccctgtgaccctcaaatttgtgtaatttcaaccaacctcaccactcactgcttccctaaagtgcaaagtgcccgacagatttccactatgcatatattaagctctaaatgacaactgctcaacatatttgaaagttcacaagaatacaggtcatcaagttctgatggtcaaagatcctggaactcactgattttagtgttgccctaagcatcctccctatctgcctaaaacttgctctcctgcagagcctgctgccaacagagtggcttgggcttcatgccccttacttttccctccaggccacataaaaggcccacatacaacagcactttaaacacacaagcatacactactcaacattagctacacagtgggaaaatttctgttttgaaaaatcaaccaatggggccaggcatggtggttcacgcctgtaatcccagcactaagggaggctgaagtggggcagatcacttgagctcagaagttcgagacaagcctgggcaacatggcaaaaccctatctctacaaaaaaatagaaaaagtagctgagaatggtgatgtgcacctgtagtcccagctacttggaaggctgaggtgggaagattgcttgagctccagaggtccaggctgcagtgggctgatactctgccactgcactccaatctaggtgccagaatgagaccctgtctcaaaaacaataaaaataaaaataaatcaaccaatgggggtgtccatgaaaaataccatggcaggccgggcgcggcagctcatacctgtaataccagcactttgggaggccaaggcgggtggatcacttgaggccaggagttcgagaccagcctggccaacatggtgaaaccccatctctactaaaaatacaaaaattagccatgcgtggtagggcgtgcttgtaatcccaggtactcgggagactgaggcatgacaactgcttgaacccaggaggtggagactgcagttagccaaggtcgcaccactgcattccagcctgggtgacagagtgagaatctgtctcaaaaataaaaaataaaatacaatataataaaaaataaaaataaataaataacatgcgacatatgacattttactactaaagataaataatggcaaaccagtcagttactatttttcatctacctcggccagccaaaactggacaccctagaagtccccaggttgggaataatgatgaacactcagatggtgtgagcaggggaacgacttcaatgagaccaggagaggtgcctctctgtgcctgcaatgccacctgtctgcctgacctccacgtccctaggctgccctagcagttctgccaccaggcccacccctctggtgtacaaggtgaaggggacacatgcaagtgctcaagactcaaactactatggggtgaggaggagggaaggcactgtaaggcagacacaagggatggcctagaaggttggttaaatggaagggagagaatatggaatgaaaataaatactggaacataggtgctgggcttaggacttgcagctaggagtgacgaagaaagggaaaaacaacttctacaagtcatttgggaagaagcggacccaagctgggacaggacaggatggaaacaggctctccaacacgatggtgccacacaggaggcagggactgtgcccgccatgccaacaacgtcccctgaaggagactggggccatagctccgaggcctgagcgccgacaagaggcttccaggcctgcacttgtgggaaggagccaaggaagggatggaagcagggagctggcccagcatcagtcacaagggcatgagacacaggatgaaagtggagtcagatttaggacctgggagccacccggcagggaaccaaagcaagtgcccttgtcaattggttgagggggttcgggcaggtcatggagaaagggagtgaaggatgtgccatggtggacacacctatggggctgtcatggaaaagctggtgatggctgcagcagtcacatctagaggcataggggcctcaacactgcacctttctaaggaatttactgtgcgtcaccaggcaacacttaaagcatgaacacagtatctgcagtttttatcattcaattaatgaatactcaccacagctattacaggaatgagtactcccaagttccctgcactgctagaagcctagaaaagaacagaattattgtcattaacgagtatgtgtttcttttattaaaaaaaaaaaacacaagatacaacatagtgttatgtaaacctggaatgtcttaatctaagagaaatgatgagagatatgcagagagaggcagagagatgctcatccagcataattttaatagcaaaaaatgaaaacaaatgtgaaaaataaaccatggttacataaatgattacataaatcatggtacttctgcataattagatatgacacagctatttaaaatacaactttctgaaaagcatttagtcaccatggaaagagcccacagcacatgtcaaatgaaaaaaaaatcaagatttaagactatgctatgattcaatcccaattatgtaataaatacatatgcataaaaaagctaggaagaaatctgtcaaagtgttagtaatgattatatatctgagtcaagggataagtgctttttactttactatttataggcttctgtatcttttctaaaataaacatatattcttcccaagttagggaaatttggggggttacttaataaaagatagactctctggctagacacacaaatgtagctaatcttcagtacacactgattagtaaaaattctggaagcactggcctaagccgacttgatttatgctcttaatctataataacagcagctgaagaccttgagcatacactgcggccaggcactgtgctcagtgcttcgcatgcactaacttctgggacgattcatgggaggtctcagtagcttgccaaggccacacagcacctcagtggtggggacagaatgccaagctgtaaacatatacacctactatgtactcacaaaaatttttttgaaaatttaaaaagaatgccaagctgttttccctgggctgggggccacaagggtggccctgcctggtcccctctgggaaaccgatagcctaagggatgcgtgatgatggagaacaacccacagaccttagtttaatttataattatagctccttgtcctccacaaggtggggcactgaggtccaatttccaggggagagcaggctcctgaaacgcccctcagacaggttacagcctctgctttctcaggtgctcagcaccaccttgtatcatcagtaccccactcttatcctgatgcctaaggtcccgctagacacgcgggacacacttctctcctgtgcactgaggtggtcccagctgtgtaccccactgggagacttgggaagttagtcagccacatgactgtcggagggcccggcatagcaaggctgaattagggacaagagtcttaggatccctgcttgcatcggccactctctcttggctgagactttcacagggggactccttcatgcagttgtcatctcaaatgccactcttcagagaagccttctcaaccagcccaatctaaagtgcccctcaccaccctgccctgtttcactctcccactcagcgccacaggcagagaggaccctgtctgtctcgttcacttctgtaacaccctcatctagagcaagggctggtaaactatggcccatgaaccaaatccaacccaacacctgttcttgcaaatacaattttataggagcacagtcacgcctgttcgttcatagacaggtgaccacagaagagttgagttgagcagttacaacagaagctgtatggcctgcaaagcgtaaaatatttacactctggccctttacagaaaaagtgggctgacccctgacctaggacagtagctggcacagagtaggtgaacaataactgtctgggggaaggggaaggaagaaatggaagagagaggaaatgacaaaacagggtggaagtagagatatggttgtgggatacattggggtttttctttaaataatctgatcaatcttttattttttaatttatagtacccccgactttttcttttttttcctttttgcctttattaaatgcctaaacacgcctcagtaccaagtgttatcaacaccaactcatattcctttccttatttaaaaaaaaaaactttctagctcattacaaacacccccttcccctttctctccactttcttttacatacccaccctatctaaaaaaatcaaatgtttagccaaccaaaattagtttaaattatatgacccaaccccagccaataaaaaaaatacaaaaacaaaacttgagtcaaaaataaaaattctcgtgccctttattcaaatatgctcttataacagctagcccaaaagacacccctctacgcaaaaataaaattgctttactaaaactcttctgttcaaatattcaatttccttaaaattttaagggttattcctaacatggtagagcgactagtgcccacgtgacatgctactggggagttacgaaggaagaggcctcacctgcctcggccccaccatgaatgtatttggggattcaagacatgacgtttatctcagtagacctgtcttccttgggaggcctgagattaggtgaaatctggcccttctcatgttgccactgtgttctgatgatgggcccttaaagtcctcctaggcccagctaccacccctgggcttcatgataaaggcaaggacagagagaggtgcccgtggggagctgaggctagactgttgtcatgtcaccaccctaggatgggtcgggcagcttttatgagctggatataacccagtgagaaaactgccctctcccctgatccccaccagcatccttgagaaagaaccccaccccttcttacttgcattccaggcacatttaaatcattcacaaagaaagtgccatattccaaccaagatggtgcctgaagactaagccttggccagcagggataggacactgatggggaaggcatagccatcctccttcctacctttagggcagggcccttctcgcttgccctctcgctggctcgcttcccctccagccccagctgcacaaacaactccaacaggttcatgagcagctcatccaccaggtgctcgtcttggatgttggccgcgatgttggccagggcattaatcactgccagggagcaatgcctgaagaagaaggagtgaaataacagccactgccaggccctcaaccgtccccaagggacggcactgcaggggtgaggcgagctgagcgggccaggcccagcctgccttaccacactcctcccagtgtctgtaaaccaaagaactctcaagtggagaagaacatgtcatcttcgtgaaaaacaacctgtagaataaagccaactgatgcagaaatgactgcaatcctctctcctgaaatgtagtaaggacctccaggagactaagttctaggcatctgcaacactgggtacctgtgagggtctcaggacacttccctcagggctgaaaatgaaagggcccatgcccaggcattccaggttggatcttgcttcccccctacaaatcacaaagagccttaaagcatcatttaccacccacagaactttcacctcatgaccagcttctccctaacgctgcctccaccttggagctgatgtcagtattttttcacatccaatgctcagcaagtgttccagggtcctgcctcaggatcttggctggcccaatgtaaaccccggatgtgaagctgacattgcccctttggccagaaacctgaaaccactgaggccaaccaggcttctgtggccctggagactgccagactctgtcatgtccaagcggcacgaccctgggtaagtctctttaagtctttgagcctcagtttcttcctaagtaaaacaaggatgataatttctcttcgtaggatcacgggaagagtgaaacaccacgtgaagcactaagcatgtcgtctgctccactaagaaatcccagagcaacggcagccacggcaaaaggcactgcagttaagtaatacctggtaggtcaagggcaaacaaagggcagtaaatgcttccactggtgaggaagacgacaaatcatttttggtgacaatatgagaaaaggctttatggaaggagaggcaagctgagccagaactgaagaactggaaggatgaagactggcaggtgctacagacacagggtaaggcatggcagaacacctaggaggggtggaagcaaaggaaaccggggaggcagctggcgaggcagctggggacactcctggagaaagggcccagcagtcacataggcgcaaggaagcaatgtgttggcctgtgtgcaggttccatggcagagaatgggacagaggaaggaaggaaaggagagcctgaccccatccccaatccagtcttcaggctgttctagtagcctgggctcatgacggtggcagcaagaaggcaatgaagtagtatcgatgcgagagacagctctattgattgggagctttcacatatgcaatctcattcccaactgcaggcaggttctcatttggcagatgaggaaactgaggcacagaggttcagcattttctgaggtcatgcagctacatggcatggctccacagctgcactcccacccactaaactgacatggagagaatccagaggaaggcctggacttcacagtcagaagggaggagcccggaggtcaagaagagtaacgcctgcaaaggggctctcttcttccctccccaccctcctgtcctcatctgacttcacctctccccttccctctcttccaaacacggatgaacatgtccctgtcctcaaggcattcctagaggagggtaaggaatagccaagaagcatctctcaatctgtcagggaaaactggtcagactttatacaagtatcaaatgttcaaggacgtttaacgcctacttccttggacccaaaatcctacttctctgaatctaacccacagaaagcatcaaagatgctcagagatatgtagctgttaggctgtcaatgctgcatttattagtgggaaaactggaaaacaccctaacatccaagctagagactggctggttaaatcttggttctactataggataggacgctccacaacctctaaaggcaacctgcgcaggatcattcatggtgtggctgatgtgctgccccataaaaaagcaggtcagctgcatgtgcagcatgggcccaatcagaaggagagaaaggagctgagacctcgtgcgctgagatgctcagtggtcacctccaggtgggggccacattgggttttcacttccccccttatgtgtgcactgatctgtagcatatagttttcttgcaagaagagtttatttaagagacaaattcacaaacctcacatttttaaagtaagttaaatactgtcatgataaaaaagtgacaatgaggtccagttacctatagccgtggtccttgtaatctttggtggctgagtatacaacggagctggccttcacactgatctgctggaagaggttccacacttcctgatagatgtattgctgggagagagcaagatgcactgtcaccatgcaggatgccctcatgaggcccctcctgtcatcacctagagagaaagctctggaatcctggggcacaacagcccaaagactatcagcccaaagatcatccatttctaaagctttaatcaaacctcaaattaaaagctaaaagggacatggcttagattcaaatcttctgttataatacactgacaagaaattaaacctctttttccccagcactcacagcatcttacactattcttactactccgcattaaaaccgttgtcagcatttagctcatctgcaaggtatatttaatctgtatttgtacatcccttatagtcaagagtttaacgtagcttgcacagggttagtggtgttctggctctggcctcccttacatttccggtgataaccaggcagcccagctggtcaataatcagcacatcgaggggggagggtggctggcagaatttctgctgtaggatctgcagaatgggctccatgaccttcggggtgtccctcaaggccaccgcaatgtgtcccaaggctcggattgtgtggtcgggaatcaagtgagcgtccctacagaaggaagaacagaagcgccctagcaacagtccctccagcatgcagtagtgaaacagtacccagagactacgatctagaccttaatttcataacagtcttgatgcagtgttcatctgaaactgacagcccaggattttaaccacgggcagaaacataagccccaggcactagtctggatgacaaagatctttctcgacttccacacagtggtccaggaagtacaatccaaggtgggcttcaccttaaatcttgtgacaaccctgatacatgcctatgctctgagacaaggagataaggacagaggcatgcatacgcacaatgccaggtgccccacacgagcctgctgagaacaatgggctgcctctgagagacaggaataggggcgtacttgtcgctctcctgagagatgtagagccggttggacaggctggccaagaacgcctccacaatcactgggtccaccgtcaatccagccttcaggcacctgaggagcaagaaaacccatgtggcactgaggcatcaaaccaagataggttttttgttttttaatttttccttccttaggcctacaaagtttaaagaactgctctgaattttcttccccccaaattggaggtcataacacagaatgaattcaaagaattactccagattttgcccacttgataaatgtctcagtcggaaacaataatttcattattttgcccagaacagtttcctttggaatatcatgctcaccctaattccaatttcaatcccttgtactgtttcttaaggtcacagtgactgattccaaagacaaacggtcccaagatagcatagtaaacatcacaattatataccaaggttttcatggtaaggagaaacatttacgttacagagaaaaggggaaaaatttaaagcccctaaaaacataaaatcttgtaagatgtcctagctctccacatctgtttggctcctgggccagagtttggaaaacagtttgagtctgacagacaagctgccatcttgatttagcttctaagggcaaggaaccagaatccagggaaagaagtatttgcatggaaatcagactgtatgtagctctcaagttggaagaacaagagtccacagtgcaggagtctgggcagcaaggggtacctaatcatattttaaaacctcacatttatattaaacattccacagaaaacaaggtaaagaaaatatgatgatacgttactctggatgttgagctaatggataatccttctctttttacttttctatacattacaatttttctctagtaagaatttcttagccaggcacggtggctcacacctgtaatcccagcactttgggaggcacaggtgggcggatcacaaggtcaggagatcaagatcatcctggctaacatggtgaaaccccatctctactaaaaaaaaaaaaaaaatacaaaaaaattagctgggcatggtggcgggcacctgtagtcccagctactccagaggctgaggcaggagaatggcgtgaacccaggaggcggagcttgcagtgagctgagatcgcgccactgcactccagcctgggcgacaaagcaagactctgtctcaaaaaaaaaaaaggaagaatttctttttttttttgagacggagttttgctcttgttgcccaggctggagtgcaatggtacaatctcggctcaccgcaacctccgcctcccgggttcaagtgattctcctgcctcagcctcccgagtagctgggattacaggcacgtgccaccacgcccggctaattttttgtatttgtagtagagacagggtttcaccatattggccaggctggtctcgaactcctgacctcatgatccacctgcctcggcctcccaagtagctgggattacaggcttgagccaccacaccaggcctcttattatgtttatgatcaggaaaagaaaagaagtaacaagaaataattcctctttatagatcaagtgtaggtttaaaataatcagaaacaagctttaaaaaagtataaatgcagccaggcacggtggctcacgcttgtaatcccagcactttgggaggctgaggcaggcggatcacgaggtcacaagtttgagaccagtctggccaacatagtgaaatcccatctctactaaaaatataaaaaattagccaagaatggtggtgtgtgcctgtaatcccagctacctgggaggctgaggcaggagaattgcatgaacccaggaggcagaggttgctgtgagctgagattgcgccattgcactcccgccccaggcaacagtgcaagactgtataaaaaaaaatgtataaatggggtgggtgcagtggctcacacctgtaatcccagcactttgggagaccaaggcaggtggatcacctgaggtcaggagttcgagaccagcctggccaacgtggtgcaaccccatctctactaaaaatacaaaaattagctgggcgtggtggtgggcgcctgtaatcccagctactcgggggaggctgaggcaggaaaatagcttgaacccaggaggcagaggtagcagtgagccgagattgtgccactgcattccagcctgggcaacagagcgagactcaatctcaaaaaagaagtataaatgtctcttattttgtaataacccgcttgtctggagcactgctgtctactcgccacttgcccagcttcccacctgcagatgttgtcaatagcgatgtctcggagctgctcgtacatggagggctggctcttcttacccgacatgacgttcagggttgactcggaatgctcattggtcacactgatttttatatcattgccagcaactgaaagtaaaaaattcaaatatatacctagttaggcctatcattttccatcaccttctttgtaattcaaaaaccaagataatatgctgatcatttataaaagcaaaatgatcactctaaaaacatctgaccaaatatttcagaaagagaagagtctaagagcaacaggaaataatatgtttaaatcaaaaggaagaatattcaagttagaaagtgataaatacagaaaactaccaatttctcaatcaactgttcaaaagtactgatgaccaaccaccaaaggcagctctgagggcgactgaggcatggccctgtgcttggagttacctcactaatatgtacaaagcctggtgagggttagggatgcttgcgggagcaggggccttagagcctgagagaaccctccccactacggggttcagggaagtcttgttttttgtttgtttttgagatagggtcttgctctgtcacccaggccggaatgcagtggcgctatcacagctcactgcatcctcaacctcctgggctcaagccatcctacaacttcagcctcctgagtagctaggactacaggtgagcgccatcacgcctggctaaatctttaaactgctctgactttaagtcttcatctgaaggggaagataaaaacagccaccttcatgagactgtgggtaagagggtgatactacatcagagacactagcacacagcaggtgtttaattaattaatgttaattattgtttcatcatatgtggaaacatcataatccattctcgcaggggtagcagggactgggcccctggctaagtgtttggggcacacaggatttgcatttcagacttccacagtgaaagatgtcaaaaagaaaacaggacttgaaggggcctttggtgtaacaggaatacaggatgagagaaggccggggaagaaaggcctggagcttggaggggacgcaaagggaaagacagaaggaaaggtgtggcgaaggaatgcacccaggtacagtcatgaaacctgtgtgaggctcacacacagtcacagagcccctttctcagggcctgaagggcacatagtctgttattacctgtgtggtactgactgtggtacttgtagagcttcaccagaactggggacgggatgaccaggaagtctcgcaaggacggtgtcacagagtgcaccaccaccgggaacctctcgcacaggcggcccaaaccctgcaacacaccatcaacctgtcacatggcctgtggtatgggaccatctgagtaggccctgagcagggaggtgctcaacccttcagtacccaagtctgacccaaaacttcgaaggtcaaagctcccacaggccacctgcccaggacataaaaagatggaagcgatggtgctgactctcctccacctataggggacatcaactactatttttttgttttgtttttgagacagggtctcgctgtcgcccaggctggagtgcagtggcacgatcatggcttactgcagccttgacttactgggcttaagcaatcctcccacctcagcctcctgagtagctgggactgtaggcacacaccatcatccctaactaattctaattttttaaattttttgtgcagacggagtctcactatgttgcccaggttgggctcaagcgatcctcccacctctgcctcccaaagtatcgggattacaggagtgagcaaccgtacctggccaggggatatagattgttaaagtgtgctcatctcttttggaagcatactaaagaagaaagggacaaaatataatttttaaacaatggcaggtgtggagtcagtgggattgtgacaaggttaagagtctcggcagagcagagctagcactgtgggtgtcaggagacatccccttgcgtggccccatggcacatgtccacagtccttcccccacaggccttgggaatggcccccagcctcacaacaacggagaactgaagccagctgcacccatatgccactgacagaaagccctggcatcctgcagggggcagcccacactcagtgatgaactgtgcacagcacgcactggttaaagctcctaaagacagaaccggcagggtctccgctgctggtgtgcccaccacagcctgaacagcaacagcgtgacaagagggaggccctacaggtgggatctgagcctctctgggttcagggagactgacctgcagacagcagatcagcaggggcaagtgagcaataatgactttgctggacgtcttggactgcagcttctcagatagcttgatgcaaaggttttctgcaccttaattcaaaaccagaagaggagatgagtgatcagcacaggccagtctttctaacacacttatccaccaagtaagcacagaatttaataaaaccccagagacatactttaggcagggcttattcatactgagaggtcacacagtgtgtgacactctctctctcttctccgctggccctaagcccccttgtccccgcagtgttcattccacagaaaacttcccattctactcctcccccagaaaaacacttcacctgaaggcactgagcttccatgtcaccacagaaaagcctaaagaaccagcaagatgcagcagagagcatacacaggccctgaggccacgggcatccccatcctcccaggtccagtgccctccatgcaggacaggacaccagacgtgcagagcacagcaggggctaatgctccactctgcacgtgcccaggaggcctactgcaactgcctgtgctggtaacagagccaagtgttctagaagtagtttggggaaacttgtggcaagaaagcctctgggtcatgcctggagctcacatgagaggcaaggcagtctgtctcaccctgctcgtccttcacagcccacaccatgaggtccacacaggcagcattcgcctgacagcgcagtttgagggggctcagctcattgtggatccggtctgcgtcatgtagaatcttctggagctccccctggctcgtgttgaactgctccagcacaaaatcatggatctccttcacaaaagaggtcgggaggtctgtaggaaagagtgtggcatcacagctgggaacaaaactacagtagaacacaggcagtgctagcagcggctacagtcttccccttttaacaaaaaccccagaaaagtagcatttgctactggccactgtgggtcctagaatgcccactggaaagaagttggataggaattgcacagctgtcctccacgtgcacacaacctggcaatcagaggaaatgatcatttcccagggatgttacagccatgctttgttttaagcagtcaacgtactaaaacctgaatacatgaaacatataaattgggaagtatcgttgctggaactacttccactgacaatatgagatacttctgtgatttttttttcttttaagaaagaggttgtcagggccaggcgcggtggctcacgcctgtaatctcagcaacttgggaggccgaggcgggcagatcatgaggtcaggagatcgagaccatcctggctaacacggtgaaaccccatctctaataaaaatacaaaaaattagccgggcgtggtggtgggcgcctgtagtcccagctactcgggaggctgaggcaggagaatggcgtcaacccgggaggcggagcttgcagtgagccaagatcgtgccactgcattccagcgtgggcgacagagcgagactcccatctcaaaaaaaaaaaaaaaaagaaagaaaaaggttgtcagataagggcaaaaactggttgcagccttgagaagagaattatctggatcttcagagcactcaccctgagtttgagagacttttcaaactctcatccccagggcctggaaaattcaggagaaccaccatgatgcacgcacaagtcagcccagccaaggcagccagcaacacacagcaggggtggtggggagggcaggggtaatccctgatgccccttcttagggagtttcaacccttgccgtggcccagatgactcagcttctgaggaatgttcagaatcagattaggaaagtggttactaaattttggtataccttcctgacaaaatattatgtgctcatcaaaacttaagcttacgaagaacactcaacagtgtgaggggagagcataggaaaaacattttgtaaaatgcataaaagattgtttcctcacttctgggaaaaacaaaattcatgaaagagggactagaagaaaatgctaaattgttgtgtgtgcatgttaactattaagctattgtctcaggttgggtgcagtggctaacacctgtaatcccagcactttgggaggccaaggtgggtggatcatttgaggccaggagttcaagaccagcctggccaacatggtaaaaccccatctctactaaaaatacaaaaattaggcagacgtggtggcacatgcctgtaatcccagctacttgggaggctgaggcacgagagaattgcttgagcctgggaggcagaagttgcagtgaccccagatcatgccaatgcactccagcctgggcgacagggaaagactctgtctgaaaaaaaaagctagtacctctacattaacagattacatgtattacaagtacttcattttcttttttttaatgtttttgagatggagtcttactctgtcacataggctggagtgcagtggcacgatctgggctcactgcaacctccgcctcccaagttcaagcgattctcctgcctcagcctcctgtgtagctgggattacaggtgcatgccactgcgcctggctaatttcttttgtatttttagtagagacagggtttcaccctgtttggcaaggctggtctcgaactcctgaccttaagtgatcagcccaccttgtcctcccaaagtgctgggattatacgcataagccactgtgcctggcctcttttttaattttttaaactatctaaatggatatgtaaaactgtatctgtccttaggacaatataacatgcacattttagataaacaccttaggaaataaactcagcaaaggagccatcatcgatggtaccggggttgcaggatcatggacagattttttaaatttgcttttttcccaaaatttcagtaacatgaccactttgctcatatgtgtttttcagtggccccagcagaaagtgagtaccagtctgcaaccactagcatgcgacagtggcctgggagccagtcttgctgtactcacaaacacatgggcaaactgtcctcacccttcatgtagtacagagtgtcacgcagcatcttgaacatggtcaggtagagagggtcactgaaggaagtgtagtagagatcagcactggggttggcctgcagggaaggcagacacacatgactatagaacagaaatgcccttctgcccaccctttgccttcacagcaaggcccagcggaatggtgattcgtgacttagcattctaaatgaagcaactgtttatcatgactcatcacttggacactctactgtcttcatcctcttaagcatcagaccaaggaaaacaggaggctcatgcagtccagagatgcctgcgggggagcagccatctgcaccctagtaggaagaacctccttgctgtggctgaagctcaccatctttggccatcattggcccagacagggacatgggaagtggtgaaggaggaagactgacaaaggccaccagagtaagggatccacactgtccatcatcccaaggatacaaattacagccaggacaccttcagatacaacttatgttttgtaattaaaactcattttaaattattctttaggaatctatttgaaatgtagcactattcttcttctgaaaaaaaaaaaaaaattcacacaaggtctaatgagttaagaaagataatagtccagcccgggtgtggtggctcacgcctgtaatcccagcatttggggaggccaaggagggtggatcacctgaggtcgggagtttgagaccagcctgaccaacatggagaaaccctgtctctactaaaaatacaaaattagctgggcgtggtggtacatgactgtaatcccagctacttgggaggctgaggcaggagaattgcttgaacctgaaaggcagaggttgtggtgagcagagatcgcgccattgcactccagcctgggcaacaagaacaaaactctgtctcaaaaaaaaaaaaaggctgggtgcagtggctctcgcctgtaatcccagcactttgggaggccaaggcgggtggatcacgagatcaggagttcaggagttcaagaccagcctgtccaacatggtgacaccctgtctcttctaaaaatacaaaaaattagccgggcgtggtggcgtgcacctgtaatcccagctactaaggaggctgaggcagaattgctttgacctgggaggcggagcttgcagtgagccaagatcacgccactgcactccagcctgggtgacagagtgagactccgtctcaaaaaaaaaaaaaaaaagataacagtccttaacttctatatactcctagttgagtaggatggaaaattatggtttatcataactcgtttttttcatttttttttttagagatagggtctcactctgtaccccaggctggaatgcagtggtatgatcacagctcactgcagccttgaactcctgggctcaagtgatcctcctgcctcagcctcctgagtagcagggactacaggcatgtaccaccatgcccagctaatattataattcttgacaagtataaaagtggtctgcaaatatagcaaatctttaaggcgccagaagttggccagagtgggatagggcatgcagtgtgaggttgacagagggtgagtgagcaggtggagaaaaaaagaatcatgtggagagtgtgagagtcatgccaattcccaggaggacactgacaggaagagctgtggttgacagcactgcaatgatggctttacagacaacgtctggtggtcctcacagggcagaaatggagaaatgagactgggagaggttaaagcagttcagggctttgactctgggagtccagacaacacgagtgttaaactttggagccttggagaccaaccatcttacaagcccacagcccagctccatcactcacgagctatgtaaataaagttcctgagctaagcctcagtttccccatatgtaaactggggattgttgtgagattcaaggagtgagtgagtaaagttctggcacataataagcatgtaataattggtagtggttattacactgattatggatactgagtaatatattgcagactctaggtcaagattacaagaaacttttttttttttagctatgaaactgtttcttcaaatggatgtttatgctaaagaacaaattacaaaacaaaaaataccagaaactgccctggttcaatgagaaggagggtcccagaggtggagtgcaggcccactaagtctccacttgtctaactgcccagcccagctctcgccctggtcctcctggtctgccctcagtcacaaatgatcaaacacttatgatggaaaaccaaaggtctctgagaccacaagctcagtctatagtgagtgagtgagagagttaaagctcaggccaatgggcagaacgacaacctgaaaaagggttggagacaaggtaggaactgcccagatgcaacttggggagttataagaactctgttacttaaccaagaaccaacccagaccaaaccacggccagcacatacatctcacatctgcaatagctcgttggcaggggtacgaagcaggaagagacatggtctacagcacatgaagggccctggtagttccttccctgcttcatacctgagccccaggtacagtggtatcaggcactgtgtgtcttaaaatcaggtgagagaaggaacaccaggcttcaataaggaatctgggtcagggacatacccatggtaataattagcctggcaaatgacaacctgtctgcatcctaaccctcaagaggggcctgacccaaatgttccccgagatttttgagacctcccagcaccaatgtaatgatttcataaataatgctgtaggccttggttccaaatacattaaagacaagagttccagccgggcatggtggctcacgcctgtaatcccagcactttgggaggcagaggcaggcagatcacgaggtcaggagattgagaccatcctggctaacacggtaaaacccagtctctactaaaaaatacaaaaaaagttagctgggtgtggtggagggtgcctgtagtcccagctacttaggaagcggaggtaggagaatggcgtgaacctgggaggcagagcttgcagtgagccgagattgcgccactgcactccagcctgggcgacagagcgagactccatctcaaaaaaaaaaaaaaagttccctagttacgcaccccttacacttaaaaaccaggacttgcatacgcctagaaaagtgtagctctgagcccagaggagcagctttggaagcaccaaaggagtgaggaagataaaagagtaggagagacccaggccagactcccagctcccacagtaactatgtgatgtgggcacgttagtgagttctcactaaaactctatcttctgtctgtaatgccaccagtcagaggcaccctgaggtgacgtatttaaaagagcatgcaacggtacctaccacagaccaagccctccgcggcaggtggattgttaccacatgaacaaggaaagtgaaaacactgcaaaaccccttccactccagcccccgctcaaactcttcctgctttctctacacacgtttaagtcaggctgatctcatggtaatgccctcagaagcgacatacctccatcacactggctacaatggcatccaaagatttgagaacagcctcctcaacgatcttcttcacctaccaaggaaacagaacctcatgaagcaactgacatacacagagacaggaatgctagctccttctaccgaaaacccatgacaaactcacatggtgaaaaatgtgatgcagataaaggccaataaatacaaattatggctatgtatcaaactatatgcacaaaatgcctttaattctgaagtcacttgggactgcttttctaccttagatagcaatgacataaaaacaaaggaaaaaggccaaactccctcagatttgttgacctgagatttctgtttccaggatgtgcagacctcaggccttgctgccatttcacccactcatggttaacaggcacagttgtgtgacatcctcttgcaatcccctcccagacatcaaggacaccctcacagccagtccttggagctcatggcacctccttcctctccgggccaggtgcactggctcttctacaactgcttaggtactcaaactagagctcatattttaaattttcaatagaagcaattattttcaccagttatctgtacagtatttagtgtaggaatgaattgttctgtcaactgcagaaccacaaaaaaaaaaaaaaaactgcccacatccacaattgtagtatttgatgaaagtcatttccaaaatgtatagataatgataaacatcctaggaaaagaaatgaaaaaccgcctaaaagaaaacctaggccagccgtggtggctcacgcctgtaatcccagcactttaggaggccgaggcaggcggataatgaggtcaggagatcgagaccatcctggctaacaaggtgaaaccctgtttctactaaaaatacaaaaacttagccgggcgtggtggtggtcacctggagtcccagctactcaggaggctgagggaggagaatggcgtgaacctgggaggcggagcttgcagtgagccgagatcgtgccactgcactccagcttgggcgacagggcgagactccatctcaaaaaaaaaaaaaaaaaaaagaaaacctaaacttgaagaaagttaaaagttaaaatatactgcaaaaaataataccccaagaaaggatgtgaaacagtcagtcttcagttagaatttctgacatggtactgggaacagccatctgtgaaggtcatggctctaccaggccaccattctatctggggcactgacactgagaagcagtttaggtagttttccttcttgacagcaacttcaaaaacatcctagcctatttagtaattcattatggttccatcctcattaattattacctatgttgtaatgtcttcttacatcttcagcctgaagccattctctgagggatttctattcacactccacacagcagggaggtggccactcctcagcacatgctccatgctatccaaattgttctcatttccaagacagcaagcccaatcttgagagtctggccttgatgacatcatcacccgtacctattcaaatctgtcttgaaccatcctagcttgattgtaacaacttcagggcccctggatctttattttgtaattttttttgagatggagtctcactctgttgcccaggctggagtgcagtgctgcgatgttgactactgcaacctccacctccaaggttcaagcgatcctcctaactctgcctcctgagtagctgggattacagggatccactaccatgtacagctaaagttttgtgttttttagtagagatgggatttcaccatgttggccaggctagtctcgaactcctgacctcaagtgatccgcccactttggcctcccaaagttgggattactggcatgagccacggcgtccaaccagggtccctgaatctgaccaaagctctggccatttaaggaatcgaacaatggccctggtgttttctctggtatcaccctcaatgtcatccaaaggtacccaaatatgaaaaagtcaggttttgttattaacccaaatagagccaccccttagaggaagtcaagcccaggaaaagcactggacttggagtcagaatccctggactggatgcagcccagctgctggcctacatatccatgacgtgtttgacaccgatttcctgacctccaaatggggatgcatgggtgcctccccaacatggttgctcaagaatgaaatgagaaaccagtatacaatgattccatgaatgttactctacttccttcattaatctgcaagtttatgactattaaattgtactttgaaatactggtactctgagtttttcttttaaaaatacaagtttcaccactagcaattttactgacatatccatggtctgttcatccatcagttctttgcttaccaggtttaagagttcccgaagcatttccaatggaatgttaaactccttatatgtgacaccgttgaaaaggggagagactgagaagctggagctgatggttgaaaagtagtactcaggctctagggcagtcccatcgggcaagcaggaggctggtgggagataaagctggaaactcagccgtggtgacaggcaactagggtacttcctcaagctgactcccccaataaccaacaaaggtgcagattttgcctttatttatatcccaattctctgcatgtttttaaattaacaactacagggtagattgcaaatccttggggactgatgcccctcacctgtgtctttcaggtcaaagactcagatatgatggtcctaatatttccatcttagacaatataacttagtatgtgggaagtgaaaaaagaattgtatcttttttatttttatttttatttttttgagacagagtctcgctctgttgcccaggctggagtgcagcagtgtgatctcagctcactgcaacctctgcctcccaggttcaagcaattctcctgcctcagccttccgagtagctggaataacagatgcccgtcgccacacctaggtaattttcgtatttttagtagagatggcgtttcgccatgttggccaggctagtctcgaactcctgacctcaagtgatccacctgtctcggcctcccaaagtgctgggattacaggcgtgagccaccatgcccagcagaaatacacctttttaaaggtgaagagatatgaaagcttggggtccacagggcctcagagatattttctcaccaaaattagaaaaaaaaatgcacactactagaagtttcaaagtcagagcaactaagtgaaatacacctgtcactaaaagacaaatactgtacgatcccacttattagaggaacttaaatcatacatagaggtagaatggtagctatcagtgactgggggaaggggaaatggggaataattgatgtatagtttcagtttcacgagatgaaaagagtttttgagatgaattgtagtgatagttgcacaatattataaatgtattcaatactactaaactatacactttaaaataattaaggccaagcatggtggctcatgcctataaacccagagttttcgaaggctgaggtgggaggattgcttgagtccaggaattcaagaccagcctgggcaatatagggagatcctgtctctacaaaaaataaaaattagccggatacagcaccatgggcctatagtcccagctactcaggaagctggagcaggagggttgcttgagcctgggaggtcgaggctacagtggagctatgaatttgtcactgcactccagtctgggtaacagagtaaaatcctgtattaaaaaaaaaaaatgacatagcaaattttatgttatgtgtattttaccacaataaaaaaaaaagaaggaaaaaaatcaacaaaaataaagtcattcagtcatttgacatttaataaatataaacccagacccaatgcagtggctcacacatgtaatcccagcactttgggaggctgaggtgggaagatcgcctcatcccaggagtttgagaccagcctgggcaacacgacgagaccctgtctctacataaataaaattattttaaattaaaatagaaatatagtaaataggaacccaaaagcatataattgtttgaaaatccattatttagaaactataatagaaaactatgaggccaggtgtggtggctcacgcctgtaatcccagtactttgggaggccgaggcgggtggatcacaaggtcaagagattgagaccatcctggcaaacatggtgaaacgctgtccctactaaaaatacaaaaattagctgggcgtggtggcacgtgcctgtaatcccagctacttgggaggctgaggcaggaaaactgcttaagcccgggaggctgaggttgcagtgagccaagattgcaccactgcactccattctggtgacagtaggagactgcgtctcaaaaaaaaaaaaaaaaaaaaacaaatcaaaacaaacaaacaaaaaactatgattgaaaaacagatgaatttgtaatattttcataagacagtatcaattcataaagaagtgaatactaaattttatgactttttcaagcactagagaacagactcaaagagtttagtttagctccagttgtgtcaaagctggtatctcacagctggcagcacactgccaatctgtctaaagaggacgcaaaccagcaacttacagcagaaaggatgggcaacaataccactgggagctgagacgccaagaggccaacataagaaatggccactgaaagagggaacaagtaaggaaagaagggagggagaaacagccggattaaaaagggtagatgagggagaagggaaggttgtgattatcgggcacttctcagaaagacaccatgaaatatgggctaagtcctgtgtggctgaaccccacagaggacacagatgatggcaaacgacaggggctgcaggaactagggacctaacatttgggatttacgcagggggtgtcattgaaacttcttttttttttttcctgtgagacaagagtctcactctgttgcccaggctgcagtgcagtgtcacgatgtctgctcaccgcaacctgcgtctcccaggttcaagtgattctcatgtctcagtctcctgagtagctgggattataggtgtgagccactgcacccggctaatttttgtatttttagtagagatcgggttttgccatgttggccaggctggtctcgaactcctagtctcaagtgatccacctgtcccaaagtgctgggattacaggtgtcagccactgtgcccaacctgaaagtttttaagcaggaaaagaagtgatcaaatttgcgctattaaaaataattcttatttattttttattttatttagtttttaagggtctcactatgttgcccaggctagtctcaaactcctaggctcaagcaatcctcctacatgggcctcccaaggtgctgtgattacaggcgtgagccacatctcctggcctaaaaacaattcttaaaaactaaattcttacagcagtttggaagagggcctgggaagggagatagaaggaccggctgtaagaaaagtcttagtatgtggtgttgtatacctgaagtcccagctacttgaaagggcaaggccagaggatcattatgactgcacccctgcactccagcctgggtgacagagcaggaccccaactcaaaaaaaagaaaaagtccaagtaaaacaggtagtttgagaggaaactcagaaggcacagggtctgctgctgtctgtcctacagtgaggcatttcagagagcagggctcgcttgtctcgtcaccactacaggcaaagtgggcggcagccaagtctgatggagtgatacgtggggatctcgcagtcagccacattagtgtgctcccatctgccacttactggatgtgctcaaagtggggcagcggtcatggagaggagccctcaccacagagggtggacaatgagctgtttaccaggaaaagggaagcctccaagggcacatcatggccatcctaaaatgccccaaaggcaggcaggtggcagtgagattttcagagcctggaggaatacattctatacttaaacaaggagttgtctctaagaggtgcgattctgagtggctgaaattagctcttatattctaacacatatatagaatgtaacctgttacattctcacagatctaagagatggaaagcttcctacatttatgtaagcccagatattccctttttccttcaaaattcccctcacatctctcgaaactgtcttgagacatgctcttttaacaaatagcattattcaaaaaaggagagactatactgaagcatggaattctgccttccccatttgctgtcccttaatctgggtcttacttccatcaagtaaggtagaaataattttaacatgtgtctgacatggcacagggtagtcacatgaatccaattcagtaaattatgtaaaagtactttgtgaacagcagagctctataaaaagtagtaatgggctgggtatggtggttcacggctgtaatcctagcactttgagagaccaaggcaggcgttcccttgagcctaggagttccggaccagcctgggcaacatggcaaaaccccatctctacaaaaaatacacaagttagtgggcgttgtggagggtgcctatagtcctagctacttgggaggctgaggtgggaggatcacttgagcccagaaggttgaagctgcggtgagccatgatcatgccgctgcactccagcctgggtggcagagtgagactctctctccaaaaaaaaaaaaaaaaaaaaaaaaaaaaaaaaaaaaaagtagtaacagtagtattactacattctttaatattatctacatacttaatgtcattaaaaaaaaatgtccagccaggtgtggtggctcatgcatgtaatcctagcactctggaaggaagaaatgggtggatcacttgaggtcaggagttcaagacaagcctggccaccatggtgaaaccctgtctctactaaaaatacaaaaattagctgagcatgctggtgtgtgcctgtaatcccagctacttgggaggctgaggcaagagaattgcttgaacccaggaggcagggcctgcagtgagccgagactacaccactgcgctccaacctgggcaacagagccagactctatctcagaaaaagaaaagaaatatccaccattagtacttccacctgaaaagaacttttacaagttaaagtgcaaaaattctgatggcaggtatataggggtctgtaagttattttctgtacttttctctctaaataaaatatttgaaaattaaatgtacttttctctatatataaaatatttgaaaattaaattttaagaaacttaaatgaaaacagaaaataaatgcttcctaaaagcttggcactctaggtccatccatgacaacagagttagtatcagcatccttaatatcacgagaagtcactgtgagcctgttctccaagtattacgtcaaaatattcttcggaaaggtgaagcccaccttcaaagtagtgaaaggcagatcctccaggggaactgggagggggcatgccgcgttcagggctgacctgaaacacacaaccacagttacatatcagaaaagaccagtgagacctccatcagatttgtcttagacaaggtcctctctgccagcccaatgtttgtacttcaagttctggttgaagcctcatttccttcctaaagcccatcacagctacagcattctctactacatgctatatcactaaattctttgtgtttagccgtatatttgacacttgattactgagctgaattgtcctcagtgttttgtgtttttgtcttttctccatgagtcaattatatacttcttaagggcaccaactgtcttccaggcaaaatagcatttggcacccaactgctatgaaacatatactttatgactatgaaatcacttataaatcttatgttggggactagcctcaacaccacctgtagggtatttgatgtttggtggcgacaaaggaatgagaagaaacaggttaagagtttataaaggcgggagccaggggaccagagcaaatcagaggccgcaaaggcctagagttttggtttttacactatttattgagtataatcacttagatttaagaagcagatgtttagggcgaaacggtgaaagggaggcagtgtgtcatatgtgtaatctatagtagcggcagtttaaatgaattttttttgtgtttaaacagtatattttcaacttattggacagcagttagtgggagcaggcttaactaggagtctgtatgtttggccatattttcatgttttaaaggagtggtttttttttttttaacacagtgtttatggataagagagtaagtcttgctcagagtatgggaacataatggcgataaggctttttttttagaggccttttgtggctttttacacctcattgttttatatttttatggccagtttatatgtgcactctataagcccttccccccaacatcttaagagggacaagacaagtctttgtattaaagagaattctagtgaaacatttcacgttacttaagtttactccaactacaaagaagagggattttcttcgcaggggagcttaacagggtctttctcctctgctctttccccagtagcccaggcccacctgagagatgctggacacactgctggttttcctcttcagggtaccctcctgacagacagtcagcagattgctggggaggatggagcggaagtcattaaaggaacgccttcgaacaccttcaagctcttccaggacacggagggaatgaggagggattttgggaaagagctttgagaggagagactcttccatgttgctgtaacgcccaaatgctcgcgagattcctatcaggcatgggatagcatacttgcaaaggtattctagaagatcaagtgaaaacgttacaatataagaaagtatcctgatagagtcatatagtaagtactaacttgtaacattgactaagatttcacaacccacccactaataactgtgaaggttcacaataagccacaataatggggtccaccccaagggctgacaagtgatatcttcaacctgtcattaacaacttcagactatgacttcaatacacccagctgccctgcttggaaggtcttcatctattcatggcacacccaaatcaataaaatagctaggccatattatcaagtaccttatacatttattcctcttaggagcatattggtagcctcacaacacagaaaaaatgacctttggaagtcaactaatctacccacagatgttacaggtgaagaaactggggcccagaagggtgaagttacttgtccaaggtgacccagcgtctatgtagcagagcaatgcacatgaccccatgtggcctctgaggatactaacacacaacaaatcaaactaaaataggaaggttttctcccatcatatatattaggtacccaacaacagaaaagactggagaaaagcaagggaaagagtaaccacaaaaccattttaagaaaaaccttaaggatactcgtacctttgtcttgaatctccaaggcctggcacatccccaagaggacatgcaaaacctgcaaaagcacctctaaaatctgtaacagtcaaggaaacaagaaaaaaaaaacataaacaaaattaggtaaatatcacgaaactaagtcagaattagaaggcacttcagacattatcttaaccaaccccatatatgatacatccctccacaacgactgtgccaagtggccaaccagctgactttccagggacaaaaccctcactctctgggctggttccgagttcctcccaatactgggccaatgttgtcctcctggggcttgtacctaccagcccttggggctgctttttcctctattaacatattctgtaaacaggtgatgggtccccaaatcttctcttttcatgggtaaacgccctagcgcttttcaaccgtattcttcatgatcataaatcctttgtaatgctaattgccagcttctgattttacggtagtccagttttctgtctggaagtgtagtgctcagaataaaatacattaacatctgggatgctggaactcacccagcatactcaccaaactcatcacagattctacacttctatgtatgtgacattagcttttctgcagccacttcacactgcttatgtgaagctcatctcaatgagcttatacataatttttaaattttttttatttgtttgagacgaagtttcgctcttgttgcccaggctggagtgcagtggcatgatcttggcttactgcaacctccacctcccaggttcaagcgattctcctgactcagtctcctgagtagctaagattacaggtgcatgccaccatgcctggctaattttttgtatttttagtacagacagggtttcaccatgttagccgggctggtctcgaactcctgacctcaggtgatccacctgccttggcctcgcaaagtgctgagattataggcgtgagccactgcgcccagtccataattatttaagttaagaaatttttttttgttcctggaagggtggcttatgcctataatcccagcacttttgtttgtttgtttgttttgaggcgcggtttcactcttgttgcccaggctgcagtgcaatggcatgtctcggctcaccacaacctccgcctcctgggttcaagcgattctcctgcctcagcctccttagcagctgggattgcaggcatgcaccaccacgcctggctaattttttatttttagtagagacggggtttctccatgttggttagtctggtctcaaactcccaacctcaggtgatcgatccacccacctcggcctcccaaggtactgggattataggcatgagccactgtgcccagccaatcccagcactttgggaggctgaagcgggtggatcagttgagctcaggagttcagacctgcctgggcaaagtagcaaaaccctgtctctacaaaacatacaaaaattagccaggtgtggtggtgcgtgcctgtggtcaggaggctgacgtgtgagggtcacttgagcccaggaggccgaggatatagtgagccaagaacagtgcaggggttcaatgatagctcactgtagcctcaaactcctggactcaagcaatcctcctgcctcagcctcctaagtagctgggattacaggcatgtgtcactatgcccagctaatttttatttttatttttgtagggataggttttgctatgctgcccaagctagtctcaaattcccgggctcaagtgatcctcctgcctcagcctcccagaatgttgggattacaggcgtgagccaccatccatgacaataagcttatagatgaggaagatacctaagtcttctttcgcacctgcttctcctgaactatgtaatctctactaacgtagttggtattttttatctttcatctacccctacaaaaactcatggtattagctttagctcactgtacaaatctgtgattcccagctttgtgccttctccaaatgaaatcaacttgctttccagatcttcattcacagcactagcttgttttgctccaatgacaggagggtcctgctaggccgatacctcactgatcaccctttgggacagtccttcaggcagttctgcaaaccctccaaaccatttggccctcagcccatataactggtccaggatgtcaggaaaggtgcttgtccaaagcatttatgaagatccactagaatgcagcaacttcatttctctcaaccattcttcttagaaaacccaggcaaagaaaaaatgaagttggtgtgacatgacttgttcataaccaagtcaaatctcttacattttcctaatattaagtaatgctgaataatctacaaaagcttgaaaagcaatagtttttccattttatttatttattttgagaccgagtctcactctgttatccaggctggagtgcaatggcatgatctcagctcactgcaacctctgcctcccaggttcaagtgattctcatgcctcagcctcccgagtagctaggattacaggctcctgccaccacgcccggctaatttttatatttttagtagagatggggtttcttcatgttggccaggctggtctcaaactcctgacctcaggtgatccacccgcctcagcatcccaaagtgctaggattacaagcctgagccaccgcacccagccactttttccattttatatgttaaagtcatgttatcacctttggtgttgacctctttattctgataaattttattcatagaaaaaagcccttaatgtccaactttttaataaaaacacattattctaacatatttaagtatttctttagccaacctacaaataaatgaagaatctaaattagtcaaaatacatcactaactgggaacatttagaatgcagacaagcaactaggcactgtttggaagaacctaggaacagcagcatacaaaaactaactttctaagcgataaatttaagaaaaagttgtatgattacattctttgtttaaagaacaggaaagtatgaaatacatgtttgtaacatttctatcaaaattaacaaaatctaaagaaagtctgtgcccttaaagataaaagcttcagctacctagaagattctcttctagctgggcacagtggctcacacctataatcccagcactctgggaggtcgaggcagaaggatcacttgaggcccggagttcaagaccagcctgggcaacatggcgaaaccttgtctctacaaaaaatacaaaacaaattagctggcatgatggtgcacgcctatagtctcagctacttgggagtcttaggagggaggctggcttgaggtggacggcagaggttgcagtgagccaagattgcaccactgcactccagcctggatgacagagcaagactgcctcaaaaaaagaaaagaaaatgatcttctatgaatgacttcaatccccaacaaagagcaagaaaaatgagctgcctctgcctttttctgccgcctaccttaaaggactttctgaaaagctgaaagggatagtgctgctcatgtctctgcagcccctgcccttcattagaaaaaagaaaaaaaaaaaaagaaaagtttaataagataagactcgagatcctaaagagtagtgaaagacctaagcatgtcttaggtctgctgtcaacaggatgaaatagataaatatcaacaaacaattcaatcacatttcacgtttttaaaatcttttcatcactttgggactctattcaatctaatagaaatgcataccaaatcaaccaacacatgcttacctcatccctaagtgaaggatccctataggccacatcagacagcagagttaccaagcagaagctgaagctctctgcaaccgggagggcacctggaagatgtaaaaacataaatcagataaccaggaaccagatactgggtcacacctctggccatccaattcaatatgttccctctcaccatgacctgccaagggaccagtttacagcagctgccctccttgagacgagtctcaaaagaacagctatgggcccaatgagtttgctgagaaacacccttacctttcctttaagtaaatgttttggttcaataaacttaaatgtttcctgagccaatagctagtgtgagataacaaagcctctcaacatgacagattcaattttttattccctaagtaaatgtgataaatcacacacacacacacacacacacacacacacacacacacacacacacaaaacactcggctgggcgaagtggctcaagtctgtaatcccagcacttttggggggccaaggcagacggatcacctgaggtcgagttcaagaccagcctggccaacatggtgaaaccccgtctctactaaaaatacaaaaattagctgggtgtggtggcgcacacctgtaatcccagccacttgggaggctgagacaggagaatagctcgaagccaggaagtggaggttccagtgagccgagatcgcaccactgtactccagcctgggtgacagaatgagacgccatctcaaaaaaaaaaaaaaaaatcaattttgaatattgaatgttgaatcaaggaaaaaagagtatccactatttaatagctatattcatagtacatgacagaagacttacatttctactccagcacttaaaattttaaagtgcagctctaggctgttctcaaacttgaatgtgcccatgcccggcctaaaatttgaccttttagtaatgatgctctatttaatttgtagtccatcaaattgcaggacagactgggtgcagtggctcatgcctatagtcctagcactttaggaggccaaagcaggcagatcacttgaggccaggagttcaagaccagcccagccaacatggcaaaatactatctctaccgaaaatacaaaaattagccaggcatggtgatgcatgcctgtaatcccaggtacttgggaggctgaggcacgagaattgcttgaacccaggaggtggaggttgcagtgaaccgaggtcaggccactgcactacagcttggagtgcagacagagtgagactgtctcaaaaaaacaaaaaacaaacaaaatcctaacaaattgcaggtacatgcataatttgggatctgtcagttttaggcatgttaccagaaatgatgaaaacccaaaggttaagaggaatactggcacaaacagaatgttttttaatttttatttcaggttcaggggtacatacgcagttttgttatacaggtaaactgcatgttacgggggtttggtgtacagattatttcatcatccccgtaataagcatagtacccagaaagtagttttcccatcctcaccttcctcctattctccactcttaagtaggccccagtgtctgctgttcccttctgtgttcatatgtactcgaagtttagctcccacttacaagtgagaacatgcagcgtttggtttcctgttgctgtgctaattctcccataacggtctccagctccatccatgttgctacaaaagacgtgatcttggccaggtatggtggcctcacacttgtaatcccagcactttgggaggctgaggcaggcaaataacttgaggccaggagttcgagaccagcctagccaacacggcaaaactccatctccactataaatataaaaattagccgggtgtagtggcacatgcctataatcccagctacttgggaggctgagacaggagaatcgctcgaacctgggaggcgagggttgcagtgagcagagatcgcaccactgcactccaagctgggtgacagagcgagatcgtctcaaaaaaagataaaataaaataaaaaataaaaggacataatctttttctttttttatggctacacagtactccacggtacacatacgacattttctttatccagtcttccactgatgggcatttaggttgattccttatctttgttattgtgaatactgctgtaataaacatacttacgcatgcatctttacagtagaatgatttacattcctttgagtatatacccaataatgggattgctgggtcaaatggtaatcctgttttaaattctttcagaaattgccaaactgcattccacaatggctgaactaatttacattcacaccagcagtgtgtaagtgttcccttttctctacaacctcaccagcatctgttatttcttgactttttaataatagccattctgactggtgtgagatggtatctcattgcaattttgatttgcatttctctgattattagcatcagatgatgagcatatttttcatatatttttggccacttgtatgtcttcttttgagaagtatctattcgtccttggctcaccttttaacggggttttttttttgtttgtaaatttaagttcctcatagattctggactttagacctttgcatagtttgcaaatattttctttcattcagtagggtggctgtttactctcttgacagtttattttactgtgcagaagctctttagtttaattaggtcccatttgtcaatttttgtttttgctgcaattgcttttggcatctttgtcattaaatttttgccattaaatctttgccagggtctatgtccagagtggtatttcctagtatcttccagggtgtttatagtttaaggttttacatctagatctttaatccatcttcagttgatttttgtataaggtgtaagtaaggggtctagttccaatcttccgaatatagctagccagttatcctagcgccatttattgagcagggagtcctttccccattacttgttttgttgactctgttgaagatcagatggttccaggtgtgcagcattatttctgggctctctattctatttgtctatgtgctattttttttaccagtaccatgctgttttggttactgtagccctgtagtagaggtgaagtttgaagttgggtaatgtgatgtctccagctttactctttttcagactaccttagttattcaggctcttttttggttccataaaaattttaaaatagtttttttctaattctgtgaagaatgtcattggtagtttgataggaatagcactgaatccataaattgctctgggtagtatggccatgttaacaatattgattcttcctatctatgagcatgggatgtttttccatttgtttgtgtaagctctgatttctttcagcagtattttgtaattcttgctatagagatttttcacctccctggttagctgtattccaaggtattttatcttttcttttttttgagatggagtctcactctgtcgcccaggctggagggcagtggcacaatcgcggctcactgcaacctccgcctcccaggttcaagcgattctcctgcctcagcctcccaagtagctgggattacaggcgtgcactaccatgcccagctaatttttgtgtttttagcagagatgggtttcaccatgttggccaggctggtgtcgaactcctgacctcaagtgatccacctgcctcggcctcccaaagtgctgggattacagtcgtgagccactatgcccgactggtattttattatttttgtgaatattgtgaatgggactgtgttcttgatttggctctcagcttggatgttgttggtgtataggaatgcttctgatttttgtacattgattttgtatcctgaaactttgctgaagttgtttatcagatcaaggggctttgggcagagactatagggttttctaggtataaaatcatataatctatgaaaagagatcgtttgacttcctctcttcctatctggatgccttttatttctttctcttgcctgattgctctggccaggacttccagaactatgctggataggagaggtgagagagggcatctttgtcttgttctggttttcaaggggaatgcttcgagcttttgaccatacagtataatgatggctatgggtttgtcatagatggctattattactttgaagtatgttccttcaatgcctagagtttgttgtggatttttttggggtttttttttgagacagagtcttgctctgttgccagattggagtgcggtggcgtgatctcggctcactgcaacctctgcctcccgggttcaagcgattctcctgcctcagcctcccgagtagctgggactacagatgcctgccaccatgcctggctaattttttgtatttcaggagagacaggatttcaccatgttggccaggatggtctcaatctcctgacctcgtaatccgcccacctcggcctcccaaagtgctgggattacaggcgtgagccaccacgcctggcctgttgaggatttttaacatgaagggatattgaattttatgaaaagcctcttctgtatctattaagataatcacatggtttttgtttttagttctgtttctgccatgaatcacattaattgatttgcatacattgtatcgatcctgtatcccagggataaagcctacttgacctggtggattagcattttgatgtgctgctagattcagttacctagtattttgttgaggatgtttgcatctatgttcatctattggcctgaagttttctttttttgttgtgtctctgccaggttttggtatcagcatgatgctaccctcatagaattagggaggagtccctcctccttaattttttgtaatagtttcagtaggagtggtaccagctcttctttatgcatctggtagaattcagctgtgaatccatctggtcctaggctttcttcagctggcagactttttactactgactcaatttcggaacttgttatttgtctgttcagggattcaatttcttctgggtttagtcttggtaggttgtatatgtccaggaatttatccatttcttctaggttttctggcttgtaggcatagaggtgtttgtctctctgggttgggtttttttattattattatttctgtggagtcactggtaatgtcccctttatcaatttctggttgtgtctatttggaccttttctctttttttctttgtaagtctagctagtgatctttttttttttattcaaaaaaccaactcctggatttgttgatcttctgtatggttttcatatctcatttccttcagctcagctttggttttagttatttcttatcttctgctagctttggggttagtttgttcttatttctttagttcctctagttgtgatgttaggttgttaatttgagatctaacttttcaacgtcagcattcatgctataaacttccctcttaattctgccttagctgtgtcccagagattctggtatgttgtatcttcattctcattaatttcaaataatttcttgatttctgccttaatttcatcatttacccgaaggtcattcaggagcaggttatttaattttcatgtaattatatgctttcagtgattttcttagtatttaattctatttttattgtgctgtggccctatgagttcagtttttctgaatttgctgaggcttgttttatgtcttatagtgtggttgattttagagtatgttgcatgtgcagatgagaagaatgtatattctgctgctttcgagtggagtgttctgtagatatctattaggtccatttggtcaagtgtcgagtttaaatcctgaatatctttaacagttttctgccctgatgatctgtctaacactgtcagtggggtgttgaagtgtcccagttattatgtggttacctaagcctcttcataggtctctaagaacttgctttatgaatgtggttgcttccgtgttcgatatgtataaatttgctcccgtgttggatatagtcaaatcttgctgaatcaagccttttaccattatgtaatgcctttctttgtcttttgtgatcttcgttggttggaagtctattttgtctgaaatcagaatagcaatccctgctcttttttccattttccatttgcttggcagatttttttcatccttttactttgaatgtatgggtgtcactgtatgtgggattggtctcttaaagacagcataccattgggtcttgcttctttatccaatttgccacaatgtgtcttttaaagggatatttagtccatttacattcataatattgatatgtgtggctctgttcctgtcaccatattgttagctggttattatgtaggcttgtttgtgtggttgctttatagtgtcactagtctaggtacttaggtgtgttttgttattgttgttgtttgttctttttttgagacagagtttcattcctgttgcccaggctggagtgcagtgatgcgactgtggctcactgtaacctccacctcctgggttcaagtgattctcctgcctcagcctcctgagtagctgggactacaggcatctgccaccatgctcagctaattttttgtctttttagtggaaacggggtttcaccatgttggccagcctggtctcaaactcctgacctcaggtgttccatccgccttagactcccaaagtgctgggattacaggtgtgagctactgtgcccagcccttaggtgtgtttctgtagtggttggtaataatctttcccttccatgtttagcattcccttcaagaccctgtaaggcaggtggtggtaaagaaatcccttagcatgtgcttgtctcaaaaagatcttatttctccttcactcataaagcttagtttgaccggatatgaaattcttcgttgcaaattcttttctttaacaatgctgaatatgagccaggcccagaggctcatgcctgcaatcccagcacctttgtgaggctgaggagtgggggtcacttgaggccaggagttcaagaccagcctagtcaacatggcaaaaccctgtctctactaaaaatacaaaaattagctgggcatggtggtgtgtgcctgtagtccccagttactcaggaggctgaggcatgagaattgcttgaacctgggaggcggaggttgtagtgacccaagatcgcaccactgcactccagcctgagtgatggagtgagactctttctcaaaacacaaacaaaaacaaaaacaaaaacaaaaacaaaaacaaaaacaaaacaaaacaaaaaggctgaatgtaggcctccattctcttctggcttgtagagtttctgctaaaaggtctgctgttagcctggtgggactccctttgaaggtgacctgtcccttctctctagctgcctttaacattttttttctttcatttagaccttggagaatctgatgactatgtgccttggggatggtcttcttgtgtagtatttcataggggttctctgcatttcctgaatttgaattttggcctctctagtgagattgggaaaatactcatggataatatcctgaaatacgttttccaagttgcttattttctctctccctatctttcagggacaccaatgagttgtatatttggtctctacataatcccatatttctcagaggtgttcattctttattttctttatttttgtctgagttattttggagagctggtctttgagctctgggattctttcctcagtttggtcaattctgttgtttattttgaaattctttttttttttttttttgagatggagtcttgctctgttgcccaggctggagtgcagtggcgcgatctcggctcactgttgcctctgcctcccgggttcaagcgattctcctgtctcagcctcccaagtagctgggatttacaggcgtgcgccaccacacccagccgatttttgtatttttggtaaagatggggtttcatcaccttggcaaggctggtcttgaactcctgaccttgtgatccacctgccttggcctcccaaagtgttgggattacaggtatgagccactgcgcccagccgaaattcttgaagtgagtttttcagctccatcagctcagtttggttgttttctttttgagacggagtctcactctgttacccaggctgaagtgcagtggcatgatctcagctcactgcaacctctacctcccaggttcaagcgattctcctgcctcagccacgcaagtagctgggattataggaacctgccaccacacctggctaattttttgtatttttagtagagatggggtttcaccatgttggccaagctggtctcgaactcctgacctcaagtgatctacccaccttggcctcccaaagtgcagagattacaggtgtgagccactgtgcccggccggttttttcttaaaatggccatttcatcttacatctcctatatcgttttattgtatcctttacagtctttggattgggtttcaactttctcctgaatgttgatgatcttcgttcctatccatattctgaattctatttctgtcattttggcttggttaagaaccactgctggggaactagtgcagtcaacttagcagcaagaagacactggcttttggagatgccagagttcctgtgctggctctttcttatcttcattggctaatgttctttcaatctttgaagctgctgtcctttggatggatttttttgggggtggtgcttttatcttctttgatgtctttgggggtttgattgggttcagtcaactggcttcatttctgacagatttttgggggactaaggctcagctcagcactcctgggctatgtcctccaacactggggggctggtattgggcactcagctttgttctctggctctctgaggttgagaacatgcagcactggaggggttgaggtgttcttgggccacagccacaacactctgaagggtagtgccagccaaagcactctgtcggatagtggcagcctatttgcttgtgacagcagcaccagcagtgcaatggggtgcatgctcattggctgaggcagggtgctaggaggcctggggctgcctgcctctatgtgggcattggcagtagcagtggtgcacggccgctggggtctgtgtgcacatttgcaccaatggcagtggtagcacagagttagagctggtgacctctgtgcatgcgttcatgcctgtggcggtggtgttgcggggcccagaatgttaatgagaacagcaaaacccatctttagcagactgggacatgttgcccagactagttttggtttgtttttgtttttttttttttttttttttgagacggagtctcgtgctgtcgcccaggctggagtgcagtagcatatctcggctcactgcaacctctgcctcctgggttcaagcaattcttctgcctcagcctcccgagtagctgggactacaggcacacaccaccatgcccggctaatttttgtacttttagtagagatagagtttcaccatattggccaggctggtcttgaactcctgacctcgtgatacacccgcctcggcctcccaaagtgctgggattacaggtatgagccaccacgcccggccgacccagactagtcttaaactcctgagttcaaacaatctgcccacctcggcctcccagagtgctagaattacaggagtgagccaccataccagccaatttattccgtttctaaaggtgcaaagtttaactggaacttagaaacaaagtgatgaaactatttacagtgaacattgctgttgggtctccaacctccatctcaccctttttgagcagcagcaatataatctggaaaactgacctcactccaggagtgagcctataaattctaagggtaacagtgactgatttggggacgggcagatgacccaattctggccaatgagacatgagaaaaggttcttgaaggtctcaacgttcttgctcactctcagaagaatgcaatggaaagctggcctacccaggcctaccttctccccaactcatccatgggctgtggccaacacatggatgtaagctcagcccacaatgctgcaggcagttgtttcccagccaggagggagacaagatgcatctgatgtgtcagtatgaataaacacttgatcctacagacactgaacatgtgtattttctcttatattcagggaaaacattatatacaattacctctgcctttccgagctgtgctttcttctacccaatacacttttggaagacctttgagaagtcgaagaaggtaaggaaccacacaatctttgtgctaaaaaataataagaagaataataaattagatttaataaaataagtgattggcagctttttagcccagattaagcccaaagcaaagcatatccacatcctaatcatctcagagattctccagggataatgtaaagtgcatgtaaattcacatggcatcactccattcctgttttcacactgcagagtccagaggctgtcctatcaacctgtaccacaggagcctaaggaagggttcgcacctgccttctggagctgagggtccagcctgctcaggcctcttctgggggctgggcctctccaggaggtacacgtgtgtacacactcaaagctgtcttcagtgagaatggtttagagccccaaaacccatccatgagccccagaataagatcctggggatggagagaagctcacaatgcgggcatctcaactgggtgatgcttttttctgttcatgtcccttgtccattttccttgtgttttttttttttaattttctacttcatgtttcctcttgttcttctcaagttgagcatcagactttatagccaactttagcccagtgaaaaattttactttcctctaatttctgaactagccaatcaacaccaatatatagcttcgtaatcttccatcattggcttttggagctatttccctatttacagatgttccagttaaggattagatgtgctccagagaagaagtgtgctctagagaagaggagtactatttgatgttttgaaatgctgacaaaccacatggtagttttaaaaacatggctgcagccaggcatagtggctcatagtggctcacacccgtaatcccagcactttgggagacccaggcaggtgaatcacttgagctcaggaatttgagacccagctggccaacatggcaaaaccctgtctctactaaaaatacaagtattagctgggtgcagtgggacgtgcctgtagtcccagctacttgggaggctggggtgggaggatcgcttgagcatgggaggtgaagactgcagtaagtcaagattgtgccactgcactccagcctgcgcaagagagtgaaatcctgtctcgaaaaaaattaaaacataaaagcatggcagaaggtggccgggtgcggtggctcacacctgtaatcccagcactttgggaggctgaggcaggcggatcacgaggtcaggagatcgagaccatcctggccaatatggtgaaaccccttctctactaaaaatacaaaaaattagccaggcatggtggtgggcacctgtagtctcagctacttgggaggctgaggcatgataatggcataagtaaacccaggaggcggagcttgcagtgagcctagatggcaccactgcactccagcctgggcgacagagagagactccatttcaaaaaaacaaaacaaaacaaaacaaaacaaaacaaaaaacaacaaaaaaacatggcagaaggcatgcagcttccacctggctctttttcaggacatttgccctggaacctagacactatgctgtgataagacccatgaatgagacttcaggtgattcctgcccccagcttttgagccaccccaaccgatgctaaatggagtcagttgagccctgtctaaattgcagattcacgaatcaaacaaaatgatgtattaagcactaagtctggggggactttgttataccataatagataactaaaaacaaagaactttatcaaaaacaaaagttttttctctaaaccataaaaaggaactggctaagacatctgtcgaggatcctagtgtacagacaggaacaaaactccataaggcctgaaccacatggcctcctgcagaggaagtggctccaggtggctctttcctatataaactgtgatgacattagcagcacagggtgagtaaaaccacctcagctcctctggccacagctgctaccatggcagcccactgctgggacctgaaggaggtcaatgcacagcccatcctggagggaagcaaggaatataagcaccaggtaaaaaccaaggtggtccctagggctttctcagggggctggcaaagcatgctaggcttctctcctagtatatgcaaggccggtgggctgccctggacatacaggcaaactctatggtccaagggacaacatcacatgccacctgggaccctgctagtccttacccagaacctgaatgacacttgtgctcatctatttgttgtcatcttaagaagtctaatacaagtacaacactttcaggacttacaggtaaatctatcaagaaacgtgtttgccaaagatattatcaagtaatccacatttgaacaacaatagtttcttataaatttttttaaaattattttttgccctttataattcattttatatttatgtaggatatggtaaacagaaaaaaaaaatggttttctttcttttcacatttataaataaacaggcaagctgggtatggtggcacatgcctgtaatcccagcactttgggaggcctaggcacgaggatcacttgagaccagggttggagatcaacctgggcaacctagcaagaccctcatttctacagaaaattaaaaaatcatgccaatgcctataatcccagctgctcaggaggctgagatgggagaatcccttgagcccaggagttcaaggctgcattaaataatgactgtgccactgcactccagcctaggcgatagagtgacactctaagaataaataaataaatagcagaagaaaggccaaaatgtagcttatgtatctaattttggttttttatgtaaccttgatcaggtaacctatttaattattaaaatactgctctataattaaaattcttatttgtttccaatgtacaaatactgttaaaatattaatgcttattagagcaaaatttccaggagatggaagcaacctgttctagataaatattcaaatatctaacatctttatttacctaacacagcataattaacttggaatttagaaatagtatctagtaatgataaaaataaataaataaataaaagattcaatatccaatgatcaatcatttgtttcaaatagctttggtaaatataaaaatacacatacacaacagtcacactatttttttgttggagctacagggctagattttaagtccctattaaaaggtacactgaggccaggcatgatggctcacacgtggttcacgcctgtaatcctaacactttgggaggcagaggcaggcggattacctgaggtcaggagtttgagaccagcctgcccaacatggagaaaccccgtctctactaaaaatacaaaaaaattagccaggagtggtggctggtgcctgtaatcccagctactcaggaggctgaggcaggagaatcacttgaaccctggaggcagaggttgcagtgagccgagattgcaccactgcactccagcctgggtgacaaagcaagactccatctcaaaaaaaaaaaaaacaagatacactgatacatactctaaaagtttatatacataatcgcaattttgaaaaagatgatattatatcaaaattacctaaaatgattttgtccttttggaaggagaaatacaatacccctgagtctgactgataagcattttacctgagcttgaaaaccaaacctaccctggaaggcacacaattacttctcaaagcattttaacttactctgtggcacataataacaaacaaacaaaaatacactttttttacaacataatatatgcacacaattctaaaaaactcaaattttctaagaaggtttacattaggaagtttcattcccaccttgtcctaccctctccactaaccactttgattaggttcaaatgtattcttctactattgctttaggtaaatataagcagatacaaacttaaacgctcactacacccccttttacaatgaagaaacttttaatttcatgaagacttacctgaagatcagattcaatcagaaaaatgcccaatgcaatcactgcatctctccgtctttcatctaactggaagatcccatggaaatccactggacacatgcaaagaagcttttggacctagaaaatgagacccccccaaaaacagctctacaaaatagaaaaccacattcaaaataaagcaagctgagtgcagtgtcatatgcctgcagtaccagctattcaggaggctgaggtgggaggataacttgagttgggagtttgagactagcctggccaacatagtgagaccctatctcttaaataaataaaaataaaaaataggccaggtgcagtggctcacacctgtaatcccaaccctttgggaggccaatacaggtggatcacctgaggtcaggagttcaagaccagcctggccaacatggtgaaaccccatctctactaaaaatacaaaaattagccaggcgtggtggcgcacacctatcgtcccagctacttgggaggctgaggcagaagtatcacttgaacccaggagacagaggttgtagtgagccaagatcgtgccactgcactccagcctgggtgacacaacaagactctgtctcaaaaacaaacaaacaaacaaaaccactaccataaaccccaaagagtccatgtaaccaataagtcatagttttttttcagttaaaagatcacaggacatctccagctgctgaaacaattgtacacgtgcccctcaaaacacataaactctgagtaatatgagctgaaggttaaaactgtgtatactcagagggggtaagacacaatggctaaagtttgcattttggtgttaggacagtctaagtgggtgtccccaccccttgaccacgaacaggttacccaaaccaacctgcattaacaatgcctcactgactcttttaaaaaatcaaatgcatggccaggagcggtggctcacgcctgtaatcccagcactttggtaggccgaggcaggcggatcacgaggtcagaagtttgagaccagcttggccaatacggtgaaaccccgtctctactagaaatacaaaatgtagccaggcatggtggcgagcggctgtaatcccagctactcaggaggctgaggcaggagaattgcttgaacccggaaggcggaggttgcagagagccgagatggcaccactgcactctccagcctgggcgacagagcaagactccgtctcaaaaaaaaaaatcaaatgtgtgaagcagttgggactgagcacagcatatagtaaatgctcaataaacattatctattgttattggatatactataatagtggctagtggaaggcaaaagcagacaatgagattcaaagaatgctgattaatgagtcaatcactgaagcacagggaagaactggccctatcaaagcctatgtactttgctctgtcctatgcaatactttatcaataccctgcactaaaacacagaagatacattccactacaaacctggcagatgaaactaatgtgctagaagacagcacgaagacttgaaaactcatcaaaattggcataacatcattatttctccaacaatagtgcctgaaagacaacttttgataatgtgatcagggagggcctctctaagatggttccttaaattgggatctgatcaagaaggaagccaggacaaatcaggaaaggctgctgctgcagcagcacagtggaaaagaagaagcaaggaggcccaggagttcaggtccagacagagaaggtccccagagggccccacaggccaggtcagaagcctgaattgtatcctaataacaaacacatagaggccttagggcatcaagtttagaactgaagtctagaagaatccctctggctgatacacagaaaatggattttggaggacaagagtgaaaacagagacaggtgaggagactcctgcagcagctgaggagactcctgcagcagctgaggcgaagatgttagcatggtagcaatcaacgagtagagacagaaacagaccagttcaggatgtgttttgaaggaagagttaagaggacttgatgatggacaggatatgggagagattactttagttgcctctttaccacactagaaagtatccaggccaggtgcaaggctcatgcctgtaatcccagcactttggaaggccgaggcaggaggatcacttgagcccaggagtttgagaccagcctgggcaacacagtaagaccctgtccctacaaaaaaataacaaaattaatcagctattgtcagaggcgtgtgaaccagagcaactccatcctgaataggggctgggtaaaatgaggctgagacctactgggctacattcccaggcagttcaggcattctaagtcacagggtgagacaggaagtcaacacaagatacaagtcataaagaccttgctgataaaacaggctgcagtaaagaagccagctaaaacccaccaaaaccaagatgtctggtctcgaactccttatctcaggtgatacgcccacctcggcctcccagagcgctgagattacaggcatgagccatcgcaccctgccaccaaggctttcttttttacataaagcataagaatggatttcctctctcaggccaggtgctctgggttgggctctaacaatatcccaggatcagaattcagcatcatcaacacagtttagccatactgccagtgcagcggtcaccccacccagtagaaagaactgaaggcagcattttttaccatcctcaattcctctggactgccagggcctcctctctttcaaatgcccagaggggctctggggtactctgacttcagaccttcctcccctatccccactcaactaaaaacatttaaatagaaataatctgtgaccattcagaaattactttaaaagccaggcatagctttaaatgtgaagtgaagataccaaaaagaacaactcagagatccatgtaatgattccatgatttatgcactacactggcatgtcaggcagaataatggcacctcaaagatgtccacaccctcaatcccctggaagctgtgaatatgttactttacatggcaaaagagaccttccagatctaattaaattaagaaccttgaaatggagggatatcctggattatttagataggcccagggcaatcacaaaggtcattaaaaggagaagagagaggcagaagagggagtcagagtgatgtgagatgggggcttggccaaccattgctccctttgaaaatgaaggaaggggccagaaatcaaggaatgtgggcagctctaggagctgtaaaaggcttggaaatgatggctgggtgcggtggctcatacctgtaattccagcactttgggaggctgaagtgggtggatcacctgaggttaggagttcaagactagcctagccaacattgtgaaaccccatctctactaaaaatacaaaaattagccgggcatggtggcaggccccgtggcaggtgcctgtagtcccagctactcgggatgctgaggcaggagaattgcttgaacccgggaggcagaggttgcagtgagctgagattgcgccactgcactccagcctgggcaacagagcaagactccatctcaatatatacatattaaaaaaaaatgaaaaaggcttggaaatgagttctcccctagagtctctaaaaagatacacagccctgccatcaccttgatttcagtccagtgaaacacaggttgtgtttctaatctacagaactgtaaaattataaacgtgttattctaacaacaagtctgtggcaatttatttacagtagtaataggaaactaatgtaattggtcactggtaattaaacaaaactcaaagcctactggactgcctatcaagaaaagtatcaaactgagtaatcagattacaggcaataggccgggcaccgtggctcacacctgtaatcccagcactttgggaggttgaggtgggcggatcacatgaggccaggagttcgagactatcctggccaacatggcaaaactccatctctactaaaaatacaaaaatcagccaggtgtggtggcctgggcctataatcccagctactcgggaggctgaggcacaagaattgcttgaacccaggagccggagatagcagtgagccgagattgtgccactgcactctccagcctgggccacagagcaagactctgtctcaaaaaaaaaaaaaaggccgggcgcagtggctcacgcctgtaatcccagcactttgggaggccgaggtgggcggatcacgagatcaggagatcgagaccacagtgaaaccccgtctctactaaaaatacaaaaaattagccaggcgtggcggcatgcgtctatagtcccagctacttgggaggctgaggcaggagaatggcgtgaacccgggaggcagagcttgtagtgagccgagactgcgccactgcactccagcctgggcgacagagcgagactccgtctcaaaaaaaaaaaaaaaaaattacagacaatatttagttccttctttattattttctgtatttcccatattttctataaaaaatattgataactttagaatcagaaaaaaatacggccaggcatgggcttacgcttgtaatcccagcaatttggaaggctgaggcaggagggctgcttgagcccaggagttcaagaccaggctgggcaacatggcaagaccctgtctctacaaaaaatttaataattagccaggcacggtggcatgcccctgtagtcctagatgctcggggatccgaggagggaagattgctagaggatcgcttgagcctagcaggttaaggctgcagtgagctgtgatcacactactacactccagcttgggtggcaaagcaagaccctatctccaaacaaaaaaagaaaaagaaaagaaatacagaatataccgaagttcatgtgctgcactgatatgcttacctgaactgcaggcctaaggatcactgacaactcccaaacatatgaagaagtgtaggtctaaggtcaggagaggttgcacagatgcaaccagcaaacgttcactttcaggcaggccatgtgttatcctattcctgttttacaggttaggcaactaggtccagataagttaagtgcacctgaggcaacaggttcctaactacatcttccttctcattttgtctcttcctactccaatatttccacttctggttcatataccttcaatggttccccattgcccaatgaacactcagtgcacactcccagccccaaaacttctctcataaacccaggccgctatgtatcaattctcatttctccctgcctggcctcttccatggttttgacccatctgaaacattttgtccaacctgccctatctcccctataaaaattcaacccatccttccaagatccatctcaactgtctcaaaactctcaaacattttccagaccccagcaacttgatgtaatatctcccatcatatctctcaatagctcacatagaactctgtatttctcaagataattaccttcctgatgtcttacagttacttgtatacttatcctctcactgcagagaggcctgtgacctcctcatcactccactgcaccctacacatttcagaactttaacaactacttaatgggactaaagcggccaaggtcacagacatttgataaggtgaggaggaaagaaaagaggtacagggctactagaaagcagggtttaactacactgtgataattgtcatatagtcagtaccaggcacagtgctggcatgcagttgacactgaacaagtatctgctgccttactgaatgaatggagggacggatggaagaactctcaaatgaagtaatatataatgtacagtcactccctcatgagcgttacaatccagcaggagttacaaaactaataaaaataatacaactagcaaataacacaagtcagaaactaaacgacagagggccctgaaagcctggagcaaaatgctcttggaaactgggactcttattagaaagacatctgaaaacttgaacctgggtcctacagaaaccatcacacccagttctggtgggtgccattctccaaataatgacagctaacacatattgaacatttatcatgtgttcatctatattatcttatttaatcctcacaacagctcattaggtagctattattaatcatcccccttttacatatgatgaaacagacacagagaggtcaaagtcctaatgcaggataaagcattaaccctctagtctttgaaaaaatgaaaagaaaaataacatcaaatggcttttcagaatcagaattttacaataaactagcaagttgtttgtttttaggggtcttagggggagtgggtcattataaaaagtcattaagcccaaaatctgaccacgatggccagggttattcccatttacaaaaaggatccagagggcttctacccaccactttcaaaaggttgttaagtcaatggaccacagggaggcaacaaatatgactgacttagactttgataagaactcttggcaatactttaacccaaggatattaaaagacaggtatctcaaagatgtgaattttgactgccaaggtaaggaaatgctaaaccaaggagaaaataagattcaaggagaaagtaagtctggatgactgggcagaaaattgcagatgagaatcaaccataacagagggtatttgtaaggtatttaggtcaaaataaagctacaataatagcattataaaagttggataattaaatgatttttttaaaagagtactacttgttatttaaaacctctgggaattgtcttcctggagaaacaaaattctctgagaacaaaagactaagatttaagtattaatggtatatttttctgttaaaaccatttgtaattgtctttctcaaatgtaccatcccctcagacaaaaaatattgaatataagctgatattttcgaagtgactcagagctatcatgataaacaaaggtgactgtgacatgatacacatggacctacaaatgtaaatggaacagcacctgatcctacaagcaccctggatcagagtttcattagagatgcgcttttgagctgagcgcggtgggaagtgcctgtaatcccagctgcttgggaagctgaggtgggagtactgcttgagcctaggagttagaggctgcagtaagctatgatcgtgccactgcactccagcctgggcaacagagcagaatcctgtctccaaaaatacaaaataaaaaagatgctctttggtcatctgtagacagattcatgaccttctaacaaacaaattcagcaaggttacaggacacaagattaagatacgaaaatcagccgggcgctgtggctcacgcctgtaatcccaacactttgggaggccgaggcgggcggatcaggaggtcaggagattgagacaccatcctggccaacacagtgaaaccctgcctctactaaaaaaaaatacaaaaaaattaggcaggcttggtggcgggtgcctgtagtcccagctacttgggaggctgaggcaggagaatggcatgaacccgggaggcagagcttgcagtgagccaagatcgcgccactgcactccagcctgggcaacagaacaagactctatctcaaaaaaaaaaaaaaaaaaaagaaaagaagaaaagaaaataaattgtatttctacaacgcagcaatgagcaaattaagaaaactattccatggttaattttatgttatatgaactttatctcaattattaaaaaaaaataataaagaaaaacactaacgcaggaacagaaaaccaaatactgcacgttctcaattataagtgggagctgaatgatgagaacacaggaacacacagtggggggaacaacgcacgctggggcctgtgaggtgggggagggagaatatcaggaaaaatagctgtcaggcacagtggcccatgcctgtaatcccagcactttgggaggccaaggcgggtggatcactttaggtcaggagttcaagatcagcctggtcaatatggtgaaaccccatctctactaaaaatacaaaaattagccaggcgtgggggcaagcgtctgtagtcccagctaatcaggaggctgaggcaagagaatcactagaacctgggaagcagagattgcagtgaactgagatcaccacagtgcattccagcatgggcaatagtgcaggctcaaaaaaaaaaaaaaaaaaaaaagggtggggggccaggtgcggtggctcatgcctgtaatcccagcactttgggaagccgaagtgggtggatcatgagatcaggagttcgagaccagcctgaccaacatgatgaaaccccgtctctactaaaaatacaaaaaaattagctgggtgtggtgcaacgcgcctgtaatcccagccactcagaaggctgaggcaggagaatcacttgaaccgaggaggtggaggttgcagtgagccgagatcacgccactgcactccagactgggcaacagagcaagactccatctcaaaaaaaaaaaaaaaaagtaatagctaatggatgctgggcttaatacacaggtgatgagaagatctgtgcagcaaaccaccatggcacacatttaacaaacctgcacatcctgcacatgaacctaaaataaaagttgaagaaaaatgaataaataaaaatgtaaaaagaaaaacaactgtaataatcccagcactttgggaggccaaggcaggaggattgcttgaacccaggagtttgagaccagtctgggcaacatagtgagtctctaaaaaaaattttagaaattaaccaggaggctgggtgcagtggctcacgcctgtaatctcaacactttgggaggctgaggcgggtggatctcttgagcccaggaattcaagaccagcctggggtacatggtgaaacccaagaccaacctggagtacatggtgaaacccagtttctacaaaaactagccaggccatggtggcttgtgcctgtagtcccagctacttcagagactgaggtgggaggactgcttaagcctgggaggtccaggctatagtaagctgtgataataccactgcataccactgctctccagcctgagtgatagtgagaccctgtttcaaaaaaaaaaacaaaaaaaaccagtagaacaatttcatttaaaatagcatcaaaaagaaaaagtacttatgaataaaaacaaaagaagtgcaaaactaagaaacattacaacattgctaaaagtaaagaaaacctaaataaatggaaagacatcccatgttcatagatcaaaacagttactattgtttagatggcaatacaggccgagcacagtggctcacgcctataatcccagaactttgaggggccagggtgggtggatcacctgaggtcaagagttcgagaccagcctggccaacatggcaaaaccctgtctctgctaaaaatacaaaaattagccgggcatggttgtgcacacctgtagtcccagctacctgggaggcagaggcaggagaattgcttgaacccaggaggcggaggttgcagtgagctgagattgtgccactgcactccagcctgggtgacagagcgagactccatctcaaaaaaaaaaaaaaaaaaaaaaagggacaatatagcaatacagtccaaactaacctacaaattcaacaccatccctgtcaaaaccctaggtgagttctttgcagaaactaacatgctaaccctaaaatttccatggtaattcaagggacccagaataacaaaaacaatcttgaaaaggaaggacaaaattggaggactcattcttcccaatttcaaaacttactacaaagctaaagtaatcaagacagtatactagccaacatcaggaaagacatacagaccaaataaaccctcacacttacagtcaactgatttttgacaagggttccaggacccctcaatggaaaaaagaatagtctttccaagaaatcgtgctgagacaactggatattcacatgcaaaagaatgaaactggacccccatctcatatcacataaaatcttaactcaaaatggatcaaaaactcaaatgtaagagctaaactataaaactgctaacaaaaaacacaggtgtaagtctttgtgaccttgaaattagacagtggtttcttagatacaacacaaaaagcacaagggacaaaagaaaaaaaaaatgacaaaatggacatcatcaaaatttaaaacttttgtacttcaaagaacaccatgaagaaagtgaaaaagcccacagaatgggagaaaatatttgcaaatcatatatcttattaagaaacttttatctaaaataaagaactattacaacttaattaaaaaaatactacaatttaaaattgggcaaagaatctgaatagatatatctccaaagaagatctacaaataccccaaaagagtggctgttctaggatagaataggctggctcaacatcattaaccatcaggcaaatgcatatcaacaacagaataataagatcccacttcacatccactaggatggctataactggaaagacagacaatacagagtgttggtgacaatgtaaagaaaacaagccctctgtacaccgttggtgggaatgtaaatggtgtagtaactttggaaaacagtctggagttcctctaaaggttaaacctagagttattgtatggcccagcaattccacatctagttaaagacccaagagaaatgaaaatatgtctacagaaacacttgtacgtgaatttccatagcagcgttatttataatagtcaaaatgtagaaacaatccaaacatccacctactaatgaatggataaaatatggtatatgcatacaaatattatttagtaataaaaatgaagtaatgagatgctacaacatggatgaaccttgaaaatacgccaagtaaaaaccatcatggcaggtgcagtggctcacacctgtaatcccagcactttgggaggccgaggcaggtggatcacaacaaggtcaggagatcaagaccatccggctaacacgatgaaaccctgcctctactaaaaatacaaaaaattagccgggcgcagtggcgggcgcctgtagtcccagctactcgggagtctgaggcagaagaatggtgtgaacctgggaggcagagcttgcagtgagccgagatcgcgccactgcactctagcctgggctccagagcgaaactctgtctcaaaaaaaaataaaaataaaaataagccaccacaaaaaaccacatcttatagaattctatttctacaaaatgttcagaataaatctacagagacagaaagtaaactagtggttgtctagggatggggctggtagggctgcagggtaacagcaaggtttcttttgagggcaatgaaaatgacctaaaattgatcatggtgatggatggacaactctgtgaatacactaaatatgatgaactgtacattttaaatgggtaaattttgtggtatgtgaattatatctcaagaaagcactattgaaaaacctagcctatgaaggatcaaatcaaaccacaagcaactgccgaccagaacaaagcccaacattccctaaagtaacacaacaaaaatctaaacactcaagccaggcacggtggctcgcctgttaacaccagcactttgggaggccaaggcaggtggatcacttgaggccaggagttcaagactagcctggaaccccgtctctactaaaatacaaaaaattagctgactgtggtggcgcatgctaaaggagtccccataggtctctgggactataaatactcatttaaaaaaaaatttttttttttgagacggtgtcttgctctgtcacccaggctggagtgcagtggcgtgatctcagctcactgcaagctccgcctcccaggttcatgccattctcctgcctcagcctccccagtagctgggactacaggccaccacgcccagctaattttttgtatttttagtagagacggggtttcaccgtgttagccaggatggtctggatttcctgacctcgtgatccgcccgcctcggcctcccaaagtgctgggattacaggtgtgagccaccgcgcccggcctactaaaattttttaaaattttcgctgggtacagtgactcaagcctataatctcagcactttgagaggctgaggtgagtggatcacttgagcccacggtttgagctaagcctgggcaagatagtaagaccccatctctaaaaaaatttttctttttttacttagccaggtacaatgtgcgtgcctgtagtcccaactacttgggaggctgaggcaggaggatccctcaaaccaaggaattcaaggtggtagtaagttatgatcatgccactgcactccagcctgagtgaaaaagcaaaactgtctccaaaaaaatgtaatttctatttttaaaaatgtctaggccaggcacagtggctcatgcctataatcccagcactttgcgaggccgaagtgggcagacggcttgagccctggaatttgagaccagcttgggcaacacagtgagaccctatctattttttttttaatgtctatttatccacccctctaataccagggcctagcacagtgcctgcaacacagcaaacccccaaagatttatcatatgaacggatggtgccatcttttgctttcataatagtatagccttgggttttttttgttgttgttgttgttttttgtgtgacggagtcttgctctgtcgcccaggctggagtgccgtggtgcaatctcagctcaccacaccacctcccgggttcaagcaattctcctgtcttagcctcccaagtagctgggcttacaggcgcacaccaccacgccctgctaatttttgtatttttagtagagacagggttgcaccatgttggccaggctggtctcgaactcctgacctcaggtgatgtgcctgcctcagcctcccaaagtgctgggattacaggcgtgagccactgtgcccggctgcgttggttatcctgaatccaggcttccagataagctttaaacacagaaaaacattcaggaaaagagaatggcttctgcagcagagacagagcctctcaggactcaataaacaaatgcaagtgagacctgaggatttctgcctcaactctgtatttatttgtcagtttaccacacaaatgaaagtagcgttctggccaacttggcaatgttcatgaaaggccaagcttttctccagcatgccaacatatacaacaaaagcaaatacaaaaataaaaatataaataagccatcctggctaacacagtgaaaccctgtctctactaaaaatacaaaaaattagccgggcgtggtggcgggcgcctgtagtcccagctactcgggaggctgaagcaggagaatggcatgaacccaggaggcagagcttgcagtgagcagagatcacgccactgcactccagcctgggtgacagagcaagactccatctcaaaaagtaaataaataaataaacaaataagcaatcaggaagataaaatgcataaatttcagcaactgacgtcaatgatggaaatagctgctggtgggaaagattagaggcaaccacacctccaatgagtgcaaactgcaaacacagacagcagaaaagagaatctgcagtaaggagtgagaaatagaacatttctgccccctggggagacaaacagctggtgacacaggagggcactgagggaaggctacgtgaaggcagagggagaaagtggcctcggaagaaatcaacattgctgacaccttcatcttgaacttctaacttccagaatgaggaggaaatatatctgtgttgtttaagccagtctgtggtactttgttatggcagcctagcaaactaatagttaatatggcatggttacaggtaaagattttttcttcttccaatttcttcttaaaatattttctagttgatttaataacaatgattctggcaccgcgtataccctccgctgaccctcattatctctctcctctcgctctacggatggctcttcttaacatagcctcacaaagcaaagggaaagaggataggaaattcttggcttcatgatactggaaaaacgccaacactatgatttttactccatggcagaccactctaaagtacagactgaataaccatgaactccagaaagcccactaccctaagcaccaagccacatattctcccaactacagattagaattaactcatcttatggagcacatatgtccaccaaggagggttcagcctgtccctaatgccgcagtgccatttaaacatcagatcgggctgggtgcagcagctcacacctgtaatcccagcactttgggcggccaagaaaagagaatcacttgagcccagaaatctgagaccagcctgggcaaaatggtgagactccgtctctattttctttcaaaaaccagatcaatagttagctacgacacctcaggattctggcattctaactgaagaaaacaaagagaacattttaggacatggaaaaagggctctgatcaaagcctcctgagggtggggagaggaatagaaggacaaggaatgctatctactttgcagctctgcccatgactctcggtatcccaggatcgagggcccactggtttaatacaggcctatagaggagagacacaaacaggccactgaacttccctgacaaaggaagattaaccaggcagggccaggaggaagcttagtaggggtggctcagcaacattctgaagacaggtgagaaccaggaaagcagaacaagactagcgggcagatagaaatcaggaaggaggagtctggaagccaactgtatatggagatcccaatgttgaaaagcctcactttctttcttgcctatttttttcttcttatctttctcccagagggagagggctgaggactgggtaggatttggttcaaagggcttcacagacagagtgtcctctgaggtgggttccaatcctgggggtgggaccccagtctaaagcacagcctagcaggaaaagctcaaagctcagccatggatcagaacagatgctcaagggtcttggctttggctatgggaacatggcaggagtctagtcaccagacctgaaatatgagagtagaatgggatcttggtcaggttggggtagctcacacctgtaatcccagcactttgggaggcgaaggcaggaggatcccttaagccctggaatttgagaccagcttgggcaagatggtgagacccccatctctaattaaataaaaaaaaaaaagtagatgggatttatggtatttcattggttcattaaaggaaagagaaaaaaaaaaaagagtagacgggaaacttgtagcaaggctgacttgctgctgttcacctgagcaatcaaattaacactgcttctgatttacctggggcctagcacataccaaggagcagcaggagctcaataaatgttttctgaaagtaattttgttttttttgagacagagtctccgtttgtcgcccaagccagaatgcagtggtgagatctcggcttactgcaacctcagcctcctgggttccagtgattctctggcctcagcctcccaagtagctgggattacaggcgtccgccaccacgcctggctaatttttgtatttttagtagagacggggtttcaccatgttggccaggctggtctcaaactcctgacctcaagcgatcagcctgcctcagcctcccaaagtgctgggattacaggcgtgagtcactgtgcccagcctaaggtaatttttttttttaagtaaagtccacagagcagtaataggcttggtttcatggactgggattagagtgagtgactagagtaagtaaacacaactgtggcatgtagagagacaaaggtagggaaggttatgtcattaatgtacctcaagtgtcactaaaaccatgtcagggctgcctgagttaccaatgtctgagctgagatgtgaggtctggttctgcaaacttagccttcgccaggtcaaccctatctagatcaagccccacgcagtcctccaatctctcaggaagaaagaagagaaaaaaatagaagcaaagagaaggggaagagggaagagagaaggggagggattgggttttaaatactcatctccccctataagtctccatctttattatctcaggtgcgtactctaaaattcctttactcttaagaacaagaaacttggccgggcgtggtggctcacgcctgcaatcctggcactttgggaggccgaggtgggcggatcacctgaggtcaggagtttgagaccagcctggccaacacggcgaaaccccatctctactaaaaatacaaaaattagctgggtgtggtggcaggtgcctgtagtcccagctactcaggagactgaggcaggagaatcgcttgaacccgggaggtggaggttgcagtgaaccgagatcatgccactgcactccagcctgggcaacaagagtgaaactgtctcaaaaaaaaaaaaaaaagaacaagaaacttttccttgggaatgctaagggctttttgtcaattgcttcaaaaggaggaatgtagtaaaacacatattataggactacatattttatatatatatatttttattatactttaagttcaagggtacatgtgcacaacatgcaggtttgttacatatgtatacatgtgccagggactacatattaacaatgatccctagcataatcaagtcgcaagatcttagataaggatgagaggaattcacatatatttaatggggtcagccacttacagaagcctcctctatgaaataaggtgcttcaggggtccccagactgcccacatgtatatagttgtactcatggctaaattttttacagtgaatggatatcagcaataggaaaggacctcaagtgtcactaaaagcatgtcagggctgcctgtagaaacccatgcacaggcttccttatgttctctccctcctgtgaggatatacatcaagcttgctccttgctacagcagcaaaatattcaatacatgtgtgcagtttgtgcccaggaaagtccattagagaatcagcaccctaagtttttaatttatgcaccaccagcctagccatcagattcccagaaggaaagcaggtattcaacataaatcatagtttgtaaaaaggatctaggcatagtgaaccatctttattactaatagttacaggattgaggaaagcattcaagtgcttatttcccagatgccagccaaaggccaactttgtaagcaggctcttgtaaaaacagcagccccagtgctgctctattcactcttcttcacagaagtgattagtaatagctaggcacagtggctcatgcctgtaatcccggcactttgggagaccaaggcgggtggattacttgaagtcaggagttcaagaccagcctggccaatagggtgaaaccccgtctccactaaatactaaatactaaaccccgtctctactaaatactaaaaaatttgcccggggtggtggcacacgcctgtagtcccagctactcaggaggctacagtggaaaaatagcttgaaactgagaggcagaggttgcagtgagccgagatctcaccactgcactccagcctgggcaacagagcgagactccctctcaaaaaaaccaaaaaagtgattggtaaatgttgccaatgagactgaagtacttcctaaagtaagtggcattagggagctgccaacctgtggctatggctgtgttccttgtaaaatataatctttttcttttttttttttttttgagacagttttgctcttgtcacccaggctgaagtgcaatggcgcaatcttggctcactgcaacctctgcctctcaggttcaagcgattctcctgcctcagcctcccaagtagctgggattagaggcacgtgccaccacacctggctaatgttgggtttttagcagagacagggtttcaccatgttggccaggctggtctcaaactccgacctcaagtgatctgcctgtctcagcctcccaaagtgctgggattacaggcatgagccaccgtgccccatcataaaatataatcttgacaactgaagcagttattactacaaagctaagaatgttgcaattacagaatgttctcgtgactagtgaacatggctgaagaagcaaattgagctcaaggtgcccttttctgagttactgagtggaaagggtgctaccactgctggagctgcaggaccagcttcttaaagatcatccaattcactgcattctcttctctctcctcccagaatccagcaatcagtcataagatatatttgttggctctcctgctaagaagcgaatgtgctgactagctagcatgagtttgattcaataaaacagcactacactccattagtcagactatctaatgataacagtgctcatacattaggtacccacgtgcctttttgttgctcttcacaatactcctatgaagtactaccttgtatttgacagaagatagcaaagtatcagagaagggaactgacctgtctagagtcacactagtgaaagcaagtgatacaggatttaaattcagaggttccattttccaaactcatgtcctttccattgcattgtactccctctttagctagaagtcaggttagcaccaatctgccgggaccttctcaccccgaaggtgcatgataaaatcaaatatgagaaccgacaaggccaaggaccaggtcactctgccaaaagtgcctaaaacagcctttcagcttcatccatcagcagacagccacaaaaccactcccaactgcagcaggctggtctccggtcaccactgtcttatcttgtcggaaaacatcctctctccatgtgccaaaaagttgagtgggaaaataattccatcctttcagagctaaacactgtgctgagtctcatcgcacacgggtgggcaaagaaagttgacatttactgctcacccactctgtgccttgacctgtgcaagatgctttatgctagaactcatttaattctcaagaacaacctcattttacagataaggatacagaggctctaagagttaaatttacccaagaggacatggtaagtaagtgccagtgcagggaacaaattcaggtcccactctaaaatctgtctctttccagatctcaaggcacaccactgagttgcctttcacctttctcccaagatgaggattgctctggcatgacttcacctttctcttctgaagcaattccaagttcacttctctgcccactgacagttcactctcctttccctgccactgtcccttctgcaaacgcacaatcttttacccaacctaacgcccccagcctcgtagaataacactgcgcagttggtttacagtcacaaagcactttcaagacagtgtttcgtctcctggtcaccacagtccggtgaagccggcaaagcagataaaagcatccccattttacaagaaagccatcttcccaaggtcgcggaataaaaagcaggtgaaatcggaagcagaaccccaggtcttgacccctggtcctcggctcatcccactgctccgcacagccgcccacgatccagcctccacctccgcgatgtcacaagatgctccctgggccagcagctcacatcccccacccccatcccacaaccacccacctgcagcggccctgcaggccccgccgacccttcccccacggtccctctctcttcaccagcccctcccactagggcctccttcccccgctagatccctccgctcaggcgccccctcccgcacaggctgccggcgagcccagcctcggcctcccacagaccctcgtcccgcctccacgcttcgtcaccccagcccctcctcctgtcagcccgcggcccagcccgccgacgttaccttctccaaggatgctggtctctgcaccgccagggagcgggccagtgacaggaccgtgttgaaatagaagccccgcgaggcgctggagccggagccggagcagccgccgccgcctccgcctccgcctccgcctccccgggccggggccgccgccatcacctcacgagccgcggcgctgcccgccggctccccgctcctggcccgcgagcgcccgacctcagggcgcaggcgtaggtgcatccggctttcccgccacgtgacctctcagttgctgacactagatagggcgtggctgcggggcgggcccaccgctgcaggggagagaggggatggacagtaggctgcggttgcgcgcgccggatgtgggccccccccagccgacctgcgcgatggtcggctccgagggcggggccacctgcgcgcgacgcgcggaaggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttctctttaacctctttttgtgaatatgtaattttaagtgtacactataccaatttagtaataatcttatactttgcccatatgggccttttctgcagattttttttttttttttttttttttgagatagagtctcactcagtcacccagcctggagtgcagtggcacaatctcggctcactgcaacctccgcctcccaggttcaagcaattctgcctcagcctgtcgagtagctggggttacaggtgtgcaccaccatgcccggctaatttttttatttttttaatacagacagggtttcactgtgctggccaggctggtctccaactcctgaccttgtgatctgcccgcctcagcctcccaaagtgctgggattacacgtgacctgtagaattttaaagttacaaatgttgttcagcatcttcagctctgatgaatgcggtgtcagtacaaaatgatgagctagagccagggcatggtggctcatgccaataatcccagtgctttgggaggctgaggcaggagaatctcctgaggccaggagtttgagaccagtctggacaacatagtgagaccccacctctagaaaaaatttttaaaaatagcttggcctctagtcccagctactttggaggctaaggtgggagaattgcttgagctcaggaatttgaggctgcagtgagttatgatcatgccactgcactctggcctgggcaacagagggagaccctgtctctaaaaaataataaaatgatgagctaagttcgagaccagcctggccaacacagtgaaacgctgtctctattaaaaatacaaaaattagccaggcatggtggcatgtgcctatagtcccagctactcaggagactgaggcacgagaatcacctgaacccggaaggcagaggttgcagtgagccgagaccacaccactgcactccagcctgggtgacagagcgaaattccatattaaaaaaaattgatgagctagtcattaaaagtgctcattatggctgggcatggtgactcgcctgtaatcccagcactttgggaggccgaggcaggcagatcatgaggtcagaagatcaagaccatcctggctaacacggtgaaaccccgtttctactaaaaatacaaaaaattagctgggcgcagtggcgggcagctgtagtcccagctactcgggaggctgaggaaggagaatggcgtgaacccgggaggcggagcttgcagtgagccgagattgtgccattgcactctagcctgggtgacagagtgagactccgtctcaaaaaaaaaaaaaaaaaaggaaaaaaaaaagtgctcattatgtggggatgggatgggctctttagttcgaactgtttcagaacagcacttttcctccatgccttcaactcaacaagtgaccatattccatcaaaatgtgaagttgtttttttaaacaaattttgtctcctgtgtagttatttcttagtgagttggtggaggggatcttcctcgttgagtcttcatgcatttggtctttgatgccacgtttagccctatgaactaccttctgtcctgaaaccctctcatcagttttccggtgtgtctcctagctccctacccgctctgcagcactatctagaccagggctcagcaaatttctgtaaagggccggagagtcagtgtttcaggcttacaggccaaaccatctctatctctattgcagctgctcagctctgccattgttgcataaaagcagccaaagatccgggcgcagtggctcacgcctgtaatcccagcactttggaaggccgaggcgggtggatcacttggggtcaggagtttgagaacagcctggccaacctggtgaaaccctgtctctactaaaaatgcagaaattagccaatcatggtggggtgcacctgtagtaccagctacttgggaggctgaggcaagagaatcacttgaacccaggaggcagaggttgcagtgagccgagattgtatcactgcactccagcctgggcgacagagtgagtttcaaaaaataaagaataaaagcagccaaagacaatacgtaaataagtgagagtgcgcgagagtggctgtgttccaaagctttatttatggagactgaaatttcacataattcacatgtgataaaatgctatgaattttttttgtttttgagacagcatcttattgtagaatcaaaaggtctgagaaagcatctgtaggttaggctaggccattttggaattttttttttaattaattttttttttttttgagatggagtctcactctgtcttccaggctggagtgcactggtgcaatctcagctcactgcaacctctgcctcccacattcaagcgattctcctgcctcagcctcccaagtagctgagattacaggcgcccaccaccacgcccagataattttttgtaactttagtagagacagggtttcaccatgttggccagggtggtctcaaactcctggcctcgtgatctgcccacctcagcctcccaaagtgctgggattacaggtgtgagccacggagtctggcccatcttggaaatttttatctgtcagtgggctagctccccgtgtcccaaaagccactgtggttttagtggaatatcatctttatttatttatttatttatttatttatttatttatttattttttatttttttgagacagagtcttgctctgtcgcccaggctggagtgcaatggcgcgatctcggctcactgcaacctccaccttacgggttcaagtgattctcctgcctcagcctcctgagtagctgggattacaggtgcatgccaccaagcctgactaattttttgtatttttagtagagacggggtttcaccctgttagctaggatgatctcgatcacctgacctggtgatctgcccgcctcggcctcccaaagtgcagggattacagacgtgagccactgtgcccggccaaatatcatctttaaatatcatcattataaataaggaatgatgaggatttgaacccaggcagtggacttttctggggagacaaagaagtggacattacaagctggatgcggtggctcacgcctataatcccagcactttgggaggctgaggtgggtggatcacctgaggtcaggagttcgagaccagcctggccaacattgtgaaacctcgtctctactaaaaatacaaaaattagctgggcgtggtggtaggcatctgtaatcccagctactcaagaggctgaagcaggagaatctcttgaacccaggaggcggaggttgcagtgaaccgagatcgcaccactgcactccagcctgggtgacagagcgagactccatctcaaaaaaaaaaaaaaaaaagaagaggacattacagaggaagaagcataagtgaaaaaaatcaaggcggctcacatttggcatctgcaagtagggaactggcgttatgggttgtgggtgggagatgacatgaaaggtaggcaggatctaatctaagaggccttatgagccatactgaggagtcagaatattgcacttcaatgacagggaggtactgatggagtctaagcaagcgagtgacgtgacaagattcagattttgaaagatcataaagatgcatcaccgcattatttataaaagcaaataatggctggacgcggcggctcttgactgtaatcccagcactttgggaagccaaggcaggcagatctcctcaggtcaggagtttgagaccagcctggccaacatggcaaaaccctgtctccactaagaatacaaaaattggccaggcgtggtggcagacacctgtaatcccagctactcgggaagccaaggcaggagaatcgcttgaacccgggaagcaaaggttgcagtgagccaagatcacaccactgtgctccagcctgggtgacagagcaagactctggctcaaaataaataaatataaatataaataaataaaagcaaataataagcctagaaacaacctgattaggaagatgatggagtcaactatgttcacccatagctgcaacagacaattgcatctatgaaaagtcttcaaagataatgcttgcaagattaacataaaacattatatggtatggtcccaactttgtggaaaagcaaaccaatatatgaatttcaaacaaaaaaaaatcactcttgcatcagtgaggaggacaagctgggaacagagtaaggaaaagactttggtcatggtccaagcaagaattgaagaggggcccaaactagagtggtggcaggacagaaagggagagatggggcagactgcagagcactgggtaggacaggctttagtgaccaactcaccaatgtaggatgacgtagaaggaggaagcgaagatagcactcaggcttctgggcaaaggaattagtagacagtgtttttcacaaaaggaatacaaaaacaggccaggcgtggtggctcacacctgtaatcccagcactttgggaggccaagatcaatgggtgggtgaatcacatgaggccaggagcttgagaccaccctgggcaatatggtgaaaccctgtctctattaaaaatacaaaaaattacccacgttggtggcgagcacctgtagtcccagcttctcgggaggctgaggcatgagaattgcttgaacccaggagatggaggttgcagtgagccaagattgaccacgcaccccagcctgggcaacagaacaagactctgtctcaaaaaaacaaacaaacaaataaacaacaacaaaaaaaacatggctgggcatggcagctcacacctgtaatcccagcactttgggaggcagaggcaggaggattgcttgagtccacgtgtttgagaccagcctgggcaacatagtgagaccctgtctttacaaataataaaaaattagccaggcattgtggtgcatgcctgtgttcccagctactagagaggctgagacaggagaactgcttgagcccaggaagtcaaggctgcagtgagccatgaccatgccacttgggcaagagagtgtgaccctgtctcaaaaaaaaaaaaaaaaaaaaagcacaagcaagtttggggttagggacattgatgaactaggtactggacaggttaagtttgaagacctttgggacatccagatggatcccaggtgctgcaccaaaagttatgcacaaaacagatcagaatccctgccctcatggaatggacagagaagacaatgaataagacaagtagaaaattaataggctgggcgcggtggctcacgcctgtaatcccagcactttgggaggccgaggcgggcagatcacgaggtcaggagatcgagaccatcctggctaacacggagaaaccccgcctctactaaaaatacaaaaaattagccgggcgtggtggtgggcacctgtggtcccagctactcgggaggctgaggtgggagaatcgcatgaacccaggaggcagagcttgcagtgagccgagatcgcgccactgcactctagtctgggcaacagcgagactccatctcaaaaaaaaaaaaaaaagaaagaaaattaataggccaggccaggtgtggtggttcaggcctgtaatcccagcactttgggaggccgaggcaggtggatcacctgaggtcaggcgttcaagaccagcctgaccaacatggtgaaactctctctctactaaatataaaaaaattaactgggcatggtggtgcatgcctgtaatcccagctactcaagaggctgaggcaggagaatcgcttgaacccgggaggcagaggttgtactgagctgggatcatgccgttgcactccgacctgggcaacaagagcgaaactccatctcaaaaaaaaaggaaagaaaacaggccaggcgcagtggttcacgcctgtcatcccagcagttcgggaggccgaggcaggcagattacctgaggtcaggagttcgagactaacctggccaacatggtgaaaccccctctctactaaaaaatacaaaaattacaaaacaatttaaaaaactacaaaaattaggctgggtgtggtggctcacgcctgtaatgccagcactttgggaggccgaggtgggtagatcacctaaggtcacgagtttgagaccaatttggccaacgtggcaaaatttgtctccactaaaagtacaaaaattaaccaggcgtgctggtgggtgcctgtaatcccagctactccaggggctgaggcaggagaatcgcttgaacccgggtggcagagattgcagtgagccaagattgccccacttcactctagcctgggcaaaagagcaaaactccatctcaaaaaaaaaataaataaataaaaatacaaaatacaaaaattagccaggcatggtagtgggtgcctattaattccagctacttgggaggctgaagcaggagaatcgcttgaacccaggaggcagaggttgaagtgagccgggactgtgacattgcactccagcgtgggtgacaagggcaaaactccctctcaaaaaaaaaaaaaaagagaaaagaaaattaatagaatattaaatgtgaccatggtgaagtatttgcatatgacctatgtacattctcctgtatactttttgttgttgtttgttttgttttgtttttgagacagtctcactctgtcacccaggctggaatgcagtggctcgatctcggctcactgccacctcggcctcccaggttcaagcaattcttgtgtcttagcctcctgagtagctgggattacaggcatgccacgcctggttttttttttttttttttttttttttttgcgacagagtcttgctctgtcacccaggctggggtgcaatagcacaatctcagctcactgcaacctccacctcgcaggtttaagcgattcccctgcctcagcatcccaaatagctggggttacaggcacctgccaccacgcccagctaattttttgtatttttagtagagacagggtttcaccatgttggccaggctggtcttgaactcccgacctcaggtgatctgcccgcctcagcctcccaaagtactgggattatagacatgagccactgcacccagccatatacatattttgagacagtgtctcactctgctacccaggctggagttctgtggtgggatcacggctcactgcagcctcaacctctcaggcataagtgatcctcccaccacagcctcctaaatagctgggattatagacatgtgccaccacacccaactgatttttttattttttgtagagatggggttggccaggctgctctgaaattcctgagctcaagtgatcagcctgccttggcttcccaaagtactgagattataggcatgaaccactgcgcccagtctagaaatttattttctcacagttctagaggaaccaaagtgttgggtcccttctgagagtggtgagagaaagatctgttctgggtctctccctggcttgtacagggcagtcttctccctgtatctttatatcatcttaaggacaccagttatactggattagggcccaccccaaagaccttactttcagtaattacctttgttaagaccctatctccaaataaggtcatattctaaggtactggggattagaacatccacatatgaatttggcaggggagtcaggggagcacagttcaacccagaacctatacaaataagtttcagctggaaggagctgacatctgacggcctttcttttctttatttattttttattttttctgagacggagtctcgctctgttgcccaggctggaatgcaggggagcggtctcagctcactgcaagctccacctcccgggttcatgccattctcctgcctcagcctcctgagtagctgggacaaccggtgcccgccaccacgcccggctaattttttgtatttttagtagagatggggtttcaccgtgttagccaggatggtctcaatctcctgatcttgtgatccacccgcctcagcctcccaaagcgctgggattacaggcatgagccactgcacctggcctggcctttattttctttgcgtggctgaaattggatggagcagagatagatgactggagagttagatcaccaaggatagggctgtcatagacccagctaagacagggcacttagaaggaccctggtctttaacacatttcatggatttaaagaaatagagtagcagtttctagccttagagtcactagttagcttcgcagctgcttagcagcaggtagtagaggacctcaccaatacggctgaagttcaagagcaggactcctgaaccaggccctctgtcttgcacctataatcccaggtactcgggaggctaaagcgagaacacttgaggccaggagtctgggaccagcatgggtaacacagcaagcactggccccctacacttcttagaaaattaaatttttttttggagacggagtttcattcttgtgacccagcctggagtgcaatggcgcaatcttggctcactgcaacctccacctcccaagttcaagcaattctcctgcctcagcctcccgagtagctggaattacaggcgcacgccaccacacccggctaatttttgtattattagtagagaaagggtttcaccatgttggccaagctgctcttgaactcctgacctcaggtgatccacccgccttggcctcccaaagtgctgggattataggagtgaactactgtgcccagctaaaaattaaattttaaaaagatcaagcctcctgtccctgggctgaccagacagccaagaaaggcaagttagaaatcagggctctggcttaaggcttagggcaaaggtctggttccctgactacggtcacaaggcagaagtctaggtgccagacccagggctcaaatcagagaaaaagtaaagctgacttgacattgatctttgcatttaagtgctttaaatattccccaaaaaatgtcccaaaatccggataggacttgacttgactgacacttgcttagttgcccatgctggattgcagtgatgtaatcatggctcactgcagcctcgacctcccaggcataagcgatcctcccacctcagcttcctgagtagctggggccacaagcacatgccaccacgtcctgctaattttcttttttttttttttttagaccaggtctcgctgtgttgtgcaagctgatcttgaactcctaggctcaaatcatcctcccacctctgcctttcaaagtgctgggattccaggtgtgagccactccacccagccaggacttgaccatagactaaaagcaaaagagtgaggcaagccatttataaataggaaagaaactgctcacccgacccccaccaatgctgaaggaagcacaacaacaccctaaagaagatacaaaccttggagacaaagagcacctctaggtcatttagaaattaaaccaagctgggcatggtggctcacgcctgtaatcccagcactttgggaggctgaggcaggcggatcacgaggtcaagagatcgagaccatcctggccaatatggtgaaactccatctctactaaaaatacaaaaattaggccgggcgcggtggctcacgcctgtagtcccagctactcgggaggctgaggcaggagaatggcgggaaccaggaggcagagcctgcagtgagccaagatcgcgccactgcactccagtctgggcgacagcgagactccgtgtcaaaaaaaaaaaaaaaaattagttgggtgtggtagcacttgcctgtagtcccagctacacaggagaatcgattgaacccgggaggtggaggttgcagtgaagtgagatcgcgccactgcactccagcctggcaacagagcgagactccatctcaaaaaaaaaaaaaaaaagaaagtaaatcaaggccaggcgcagcgactgggaggccgagatgggcagatcacctgagttcgagaccagcctgaccaacatggagaaaccctatctctactaaaaatacaaaattagccaggcgtggtggtgcatgcctgtaatcccagctactcaggagccccaggtgggagaatcatttgaacccaggaggcagagattgcagtgagccaagatcacatcactgcactccagcctggatgacagagcaagactccatctcaaaaaaaaaaattaaatgaaaacagatgggtgcagtgcctcatgtctataaatcccagcaccttgggaggccaaggcaggaggattacttgagcccaggagtttttatttatttatttatttttgagatggagtttcactcttgttgcccaggctggagtgcaatggcgcaatctcagctcaccacaacctccacctcccaggttcgagctattctcccgcctcagccttctgagtagctgggattacaggcatgcaccaccgcacccgactgattatgtatttttagtagagacagggtttctccatgttggtcaagctggtctcgaactcctgagctcaggtgatctgccctcctgtaatcccaacactcccaaagtgttgggattacagacatgagccaccgtgcccggcaagcccaggagtttgaaactagcctgagcaacacggcgagaccctgtctccacacacacacacacacacacacacacacacaaacacacacataaaaaataagaataaaaataattagctgggcgtgatggtctgcacctgtagtctcagctatctgggaggctaaggcgggaggattgcttgagcccaggagattgaggctgcagtgagctataatcctgccactgcactcctggtcgacagagtgagatctcatctcaaaaaaaaaaaaaaaaaaaaaaaagacctgtgtggtggctcatgcctgtaattcaagcactttaggagggcaaggcagaaggattgcttgagtacaggagttcaagaccagcctgggcaacattgagagaccaagttctgttgtgggttgatttggcttttttttttcttttttaaaatgtggtttgtttcaagtttcccttctccacgataggctaatactgatcatgtcattccaccacttaaaacttctgttggggccgggtgtggtggctcacgcctgtaagcccagcattttgggaggccaaggcgggtggatcacaaagtcaggagattaagaccatcctggctaacacggtgaaaccccgtctctactaaaaatacaaaaaattagccgggtgtcgtggcgggcgcctgtagtcccagctactcgggaggctgaggaaggagaatggcgtgaacccgggaggtggagcttgcagcgagccgagatcacgccactgcactccagcctgggtgacagagcgagactccgtctcaaaaaacaaaaaaacaaaaaaaacatctgttgggggccaggtgccttggctcatgcctataatcccagcactttggaaggccgaggtgggtgaatcacttgaggtcaggagtttgagaccagcctggccaacattgtgagagaccctttctgtacgaaaaatacaaaaattagccagccatggtggcaggagcctgtaatcccagctactcgggaggctaaggcaggagtattgcttgagcctgggaggtggaggttgcagtgagccaagatcatgccactgcactccagcctgggtgacagagtaagaccctgtctcaaaaacaaacaaacaaacaaatcccacttctgttggctcctattaacgtgtcatttaaggaagccaattggccagtttaggcagcacatgacacagtctccactgatggccctgagtgtggccctgggttcacaggacgagaggtggctagcgtcttacaggtactaaccaaaatcacaataaatcttataatcagaagaccattattactcatttacaataagagagataactgaccagaatgtaagttttctgatgcgagcgcagagcattgtgcctggcacagagtaggcacttaagaagtttttgtaggatggatagtaagaaaaggaagggagagaagagggggtggggaaggagcaagtgaaaggggaaaaaagctcattctctttctgtaggaaggctatttgaggagccaagttaaaatcagattgaatagtgcttattcctccactagactaagtaccaccaagcaggaccatatcacattcactttgcatccccaagtctagctcctgggagatgcttaatacaggtgtgctgaacctatttgtcacttaaatgttcattatctcaggatcttacaaagggcttcttttcctgaaatccagcaaggaggagttttagtccgcatgtgtctgattacccaaagaaatgtttccttccgcttgaaggcaaagccacagtctttctttttttcttttttctttttttgagacggagtctcaggatctcagctcactgcaagctccccctcccaggttcctgccattctcctgtctcaacctcccaagtggctatgactacaggcgcctgccaccgcgcccagctaatcttttatatttttagtagacacgcggtttcaccgtgttagccaggatggtcttgatctcctgacctcatgatccgcccacctcggcctcccaaagtgctgggattacaggcgtgagccactgtgcctggcaatttttgtatttttagtagagaaggggtttcaccatattggtcaggctggtctcaaactcctgacctgaggtgatccacctgtctcggcctcccaaagtgctgggattacaggcatgagccaccatgcctagcaggaagccagagtcttgtatgagctcagtcaagcacaagtggtcccattcttgctggtccttgccttaggaatgggcatgtgccctgatgggatgggatgtaaagggagagctctcaggtttctggaggaagtgctctttgcccttaaaaagggacacaagggctggccttggtggctcatacttgtaatcccagcatattgggagggcaaggtgggaggatcatttgaggccaggagtttgagaccagcctgagcagcatagtgagagacctcatctctgcaaaaaagaaaaaaataaaagaggacacaaggccaggcatggtggcacataactgtggtcccagctacttgggaggttgaggcaggaggattactggagcccaggaggttgacgctgcggtgaatgatgatcgtgccactgcactccagtctgggcaacatagtgagaccctgtctctaaaaaaaggacacaaggaaatgactgtccttctcccactgggcattggcataactggatgtgaggcctgggataaccagccagaggatgaagccaaaacctgaaagaaattagaaccaaaaaaaatcacacagaagcagacccacggcctggacatcctgcatcttgagctgcctgctacagagttcatgttatgaaaaataataaatgcccttgcgcctggctcaaactattttgaatagggatttctgatattgcagccaaagcatgctaatacagcttgttagttaagatgattacatcatgaatccatggcgagtaaacttttgtaagaccattgagtcactctggtgttgcaagtatagacggatctgattgcctaattccaggagggttaggccctgacctcagtcatgactactttctgaataggcttggcaccaggaattgagtgggaggaacctaggtgatctaggagtttaaacaaaaataaaatcttcaattttagaagaaaagatgtcccaagaaactgctccatgatgggtaggagataaaaaagtggaaacaggtacctgagcaggaaaaactatgttcatgattttatactagctcttgaggttttagtcttgtgttaggaaaagtggatttaggattaaagtcttctgtccgtacacaatctacagcattaaaagattttaccctatcagattggcacatgcctgtgggaacagctaatcgggaggctggtgtgggagcatcacttgagcctggaagttggaggttgcagtgagccaagatcaagccactgcactccagcctgagtgacagagtgagacccctatctcaattaaaaaaaaaaaaaaatcttaccctatcaaagattcgagttcagtgaagatccattataaaatacttcctccttcaaatagagatgatgataacaggcatcgatgcaatactcttagtaagcattgactcttggttgttttttagtcaaagatttctaattctggctctattactgaaagaccatctggccacccattatggtacacaggttatataacaagaatgctatggttattgactgaaagccattttataatgagacaccctattgctattacataaaaggcagtctcagctatagaacgaattctcccttggtcagtcactgtggtcctactaatcatggagggaaaagatgtttctctcagaaaatctaaactgagtaggaaagccccaggaggtgcaagcctggttgcacattagaattggctagaagttttaataaatactcatgatagcccttgaacatatgaaaagatgcttgacctcactcctaataagagcaatgcaaaataaaactactttgaacattttttttcacctatcagattggcaagagtctaaaagttgaacataaaattttattaatatccagttctcctctacttctgagaatatggactatacaatttcctgcaccccctgaatttaggcttagcatgtgactcattctggcccataaaatgtgagcagaattaacatattttcctctgggctgaaggatttaatagctggtgctattaatcaaactatggggattctccagttctgttccccaattcagctactaagtgagaaggtgaagtgttccatttggtgcagcctcaggatgggggagtttcaccaccctggatctgagccgctgcaccgaggaacattgccctgtgtcagaaatagttaagccactgctgcataatcccagcccattgtgacacacgctgttgatgaagctgtgagtaaacaggtattctcctatattgctgcaatagtaccaaatgctaaaagcatcatggagggcaatttgaccatagctatagatgcacatttatcatttaatctatcatttaattccacttctgggaattcatcctacagaaatgcctgcatacatatgaaatgatgtatgcacaaagttatacattatggcattgtttgtaacgagagtttggaaataaatatctaagtatggagactggttaaatagactatggtctatcttcacaatggaatagtatgcaaatataaaaacaaacaaacaaacaacaaggaaactctcaaaatgctgatgtggaaattattccaggatatattgttagatttttaaaaagcaagacgcagaagagtggatatgtttcctttagtgtaagaaagggggaaaataaaaatattcttacataaacatttgtgtgatacacaagagatgaatagaagtagttaactatagggtcctccaagtcggatgggatgggagcaggacttctcaataaataccatttgtatcactttatatttgaaccattttaatacattatttttttttaatatagtactcaggtctccctgcaagccaaataaataaatcagtcttctgggatcaggactgggctttttgttgttgttgtttttttatgctatgcaggtgatcaaatgttcagtcagcactgagaatcggtgttttaagcttcagtctcagatgaaacacgatatctgagaggcagtttttgtgttgtgggtatgggtagtatttggcctttgctctgtgttctagaacctaactctgatggctcaagtaacccttctggttggaatactataactagatgagggagctccatctggcacagatgttgacagtgctgtgggatatgcccggatcatgtgccaggctatctggaactgaatactctgaactagagaattgggctagacacagagatgaagtaagatgcaaaccaatattgaatttatcaaggctgtgtggttataatcaggggtcttttttaggggaagacatctattagaagttgtggtagtaggttgggcacggtggctcacgcctgtaatcctagcactttgggaggccaaggcgggcagatcacgaggtcaggagtttgagaccagcttgaccaacatggtcaaaccctgtctctactaaaaatacaaatattagccaggcgtggtggcaggcgcctgtaatcccagctactcaggaggctgaggcaggagaatcgcttgagcatgggaggcggaggttgcagtgagccaagattgcgccactgcactccagcctcggcgacagggcaagactccgtctcaaaaaaacaaaaaagaatttgtggtagtgaccttaaaaaagttctgggtcacactgggagcaacacaaaaggcacacattcaatatagaagatttttgacctaaagttggcaaacaatggcccatgggccaaatcttgcccatcaactctacctttatggcttgtgggcaaagagtgtttttttgtttgtttgtttgttttgagatggagttttgctcttgttgcccaggctggagtgcaatggcacgatcttggctcaccgcaacctctgcctcccgggttcaagcaattttcctgcctcagcctcccaagtagctgggattacaggcatgtgccaccacgcctggctacttttgtatttttagtagagacagggtttctccatgttgatcaagctggtctcacctcaggtgatccacccacctcagcctcccaaagtgttgggcgtgagccaccgcacccagtcaagagtggtttttacatctttaaacggttggggggaaaatcaaaagaatatctcatgatacatgaagattatgtgaaattcaaatttcagggcccataaataaagttttcctggaatatagctgtacctaaacctattgggacaaagtcacatacagtgtggctgctttcccactacaatggcagagttgagtagttgtggcagacacgtacctggcactctcatccctttgtgctgctgctcagtgcactacaagttggagtgctgcaattataattcagcagtattttggccaggcgtggtggcacacgcctgtaatcccagcactttgggaggctgaggtgggcagatcacaaggtcaggagttcgagaccagcctgatcaacatggtgaaaccccatctctactaaaaatacaaaaattagccaggtgtggtggtgggtgcctgtagtcccagctactcaggaggccgaggtagaggaatcacttgaacctgggaggcggaggttgccgtgagccgagatcatgccactgcactccagcctggcgacagagcaagactccttctcaaaaaaaaaaaaaaaaaaaattgccaatgcacgttcttgtatcaaaagaagaaaagtataattttctttttttgagacagggtctcgctgtctcaatgcccaagctggagtgccgtggtgtttaatcacagctaactgcagccttgacctcctgggctcaagcaattctcctacctcagcctcctgagtagctggggccactatgcacagctaatttttaaaaattttttgtggaaatggggtcttgctatgttgcccaggctggtctcaaactcctgacctcaagtgatcctcctgccccagcctcccaaagtgctgcgattacaggcatgagccaccacaccaggccagaaaagtagactttggatgtcacactttcaaggcaaagtgtagattattttgttactgtatacaattgcaaggtcgggggcgcagtggctcacacctgtaatcccagctacttgggaggctgaggcagaagaatcacttgaacccgggagacggaggttgcagtaagccgagattgcaccactgcactccagcctgggtgacaagagtaaaactgtctcaaaaaaaaaaaaagcatacaattgcgaagtattgtgtttattatgcagtgacaccgtatctgtgctaaaagaataaaatgtatgttaacttagactaagcagtcatcacagtattaccaatttataggaaagcaacagtcagaaaaattggaaaattttggctaggtgctgtggctcatgcctgtaatcccaacactttgggaggctgaggcaggagaactgcttgagcccaggaatttgagaccatcctgggtaacacagcaagacctcatcactaccaaaaaaaaaaaaaaattggccaggagtggtggcatgtgcctgtgctcccagctgcttgggaagctgaggtgggaagactgcctcagcccaggaagtcgtggctgcagtgagctgtgatcatgccaccgcactccagcctgggtgacaaagcaaaacccgtctcagaaaaaggaaaaaaaaaaaaaaagaaagaaataaagaaaaaaaataggaaaatttcaaatggaacatcttatcagaatttctgcacaaaaatgaaaaatgaggctgggtgtggtagctcatgcttataatcccaacactttgggaggccaaggtgggaggatcacttgagcccaggagtttgagaccagactgggcaacatagcaagaccctgcctgtacaaaaaaaaattttttaattaggcaggtgtggtggcacatgcctatagtaccagctacttgggaggctgaggtgggagaatcacttgagccctggaggtagaggctgcagtgagctgtgatcatgccactgcactccaacttgggtgccagagtgaaaccctgtttcaaaaaaaaaaaagaaaagaaaaaatgaaaatgaaactgcaaaagtaagtttccaaggggcttatgtgttagccaaagaaagctgcttactggcggtgagttcattaaattgtgtttgtcgtagcagaagaaaagtgtccaaagaaaaatgattttgaatgattttccttgattatcaacgacttgatagatgttaccattagtgctcaattgttgtttatttgaggtgccaatgctgaatataaaatcactgacaaatacatttctcttgaatagtgtgcatggaataactataggcaatattctgaaaagttggccgggtatggtggctcatgcttgtaatcctaacactttgggaggccaaggacagcagactgcttgagcccaggaattcgagaccagcctgggcaacacagtgggccctcatctctaatagacttaacctctgccaggcacagtggctcatgcctgtaatccagcacttttggaggctgacgcaggcagatcacctgaggtcgggagttcgagaccagcctggccaacagggtgaaacgctgtctctactacaaatgcaaaaattagccagacgtgttggcacacacctgtcattccagctgctcgggaagctgaggcatgagagtcgcttgagcctgggaggcagaggttgcactgagccaagatcatgccactgcactccagcctgggtgacagagtgagactctgtctcaaaaataaataaataggccgggtgtggtggctcacacctgtaatcccagcactttgggaggccgaggcaggcggatcacctgaggtcaggagttcaagaccagcctgcccaacatggtgaaacccagtgtctacaaaaatacaaaaattagccatgcatgttggcgcgcgcctgtaatcccagctactcaggaggctgaggcaggaaaatcacttgaacccaggaggcagaggttgcagtgagccgagatcatgccattgcactctagcctgggcgacagagcgagactccatctcaaaaaaacaaacaaacaataacaaaataaataaataaaagacttgaactcagaccagacgtgatgaccagctgaatttaagcatattagtcagcagaggaaaagaaactaaccaggattccctcagtaatggcaagtgaacaggtaagagcccagcaccaaatgcctgccttgcagagtttttacatatatatgtgtgtgtgtgtgtgtgcattatatatatacgtattctttttaagttgagaaaacaataattcagtataacccaaagtggaatctgctaaaatgggtaacaagtgatggtggtaatcatgtatgaagcagaaaaaggcttagttgagcaaatttataaagccctggaaaatataaggtgtttagagcctatggttatttatgacattattcatctgaaactaatccatgataaaaatatatatatatttttgagacagagtctctctcagtcacccaggctggcgtgcagtggcgcaatctcagttcactgcaacctctgcctcccaggttcaagtgattctcctgcctcagccccctgagtagctgggactacaggcgcacgccaccatgcctcgctaatttttctatttttagtagagatggggtttcaccacgctggtctcaaactcctgacctcaggtgagctgcctgccttggcctcccaaagtgctgggattacaggtgtgagccaccacacccagccctttttttttttttttttgagacacagtctcactgtgtcacccaggctagaatacagtggcatgatctggggctcactgcagcttcaacctcctaggctcaagcactcctcctgactcagacttccaaagtgttgtgtttacaggcatgagccaccacacgtggcaactgtagctattattttttgatacggagtctcactctgtcaccaaggctggagtgcattggtgcgatctcggctcactgcaacctccacctcctgggctcaagcgattctcctgcctcagccttcccagtagctgggactacaggcatgtgccaccatgcctggtctttagtagagacggggtttcaccatgttggccaggctggtcttgaactcctgacctcagctgatctgcctatctcggcctcccaaagtgttgggattacaggcatgagccaccgcagctggtctggcgattgtaattattttagaagacaagagtttaagtataataccatctagaaaccctgggaatatgcaagctaaggaagaatcaaaatctatatgttacagcttttttttttttttttttgagacggagtctggctctatcgcccaggctggagtgcagtggtgcaatctcggctcactgcaagctccgcctcccgggttcacgccattctcctgcctcagcctcccgagtagcggggactacaggcgcctgccaccatgcccggctaattttttgtatttttagtagagatgggttttcaccatgttagccaggatagtcttgatctccttacatcgtgatccacccacctcggcctccaaaagtgctgggattacaggcatgagccactgcgcccggcctattacagcttttttaatggtttctttctgtttctctactcattgctgttttgctatctcagcatttagtaactttttttggaatgtttttgacagggtcttgctctgttgcctaggctgaggtgcagtggcacaatcaaggcttactgcagcctcgacctcctgggctcagatgatcccccaacctcagcctcctgagtagctgggacttgaacacctgggctcaagtgatctacccaccttggcctcccaaagtgctgggattacaggcatgagccaacatgcccagcctggaaagtttattttatgcttgtctcaactgtgctaaggaaaaataaaggaaagtatcttttacaaaaattttattatgacaaattccaaacatacataaaagtattatagaatataattaaccctaccctcgcatcatgtcacctggtttcaataattatcaatctcacatggccattcttgtttcacttttatctaacccacaccttattcccctctggagtatttagaagcaaaatgagagatatttggttctttttttttttttttttttgagatggtgtctcactctgtctcccaggctggagggtagtggcacaatcttggctcactgcaacctccgcctcccaggttcaagctattctcctgtctcagcctcctaagtagctgggactacaggtgagcgccaccatgctcagctaattttggtatttttagtagagacagggtttcactatgttggccagactggtcttgaactcctcacctcaagtgatctgcccacctcagccttgcaaagtgctgggattacaggtgtgaaccactgtgcccggactttacttttttctaaaaagagagtttatttaaggaaaatagagagcagagagtttatttttacaatgtttttacattgactgggtgccgtggctcactcctgtaatcccagcactttgggaggccaaggtgggcgggttgcgaggtcaggagttcaagaccagcctggccaatatgttgaaacctggtctctactaaaaaatacaaaaattagccaggtgttgtggcatgcgcctgtagtcccagctactcaggaggctgaggcaggaagaatcacttgaaccagggaggcggaggttgcagtgagccgagatcacgccactgcactctagcctgagcaacagagtgagactctgtctcgaaaaaaagaatgtttttactttttttaaaatagagatggggttttgcaatgttgtccaggctggtctctaactcctggcctcaaaggatccacctgcttcaccttcccaaaatgctgggattacaggtgtgagccactgcacctggccaagagcagatagtttatatagacagatagtacaccctgaaaagatgaggcaaagagggctgaggcaaagagggctgctgaaaagggagtgagccagcagctaatgttcaattatcatttttctctggcttcctcccatctttatccatctacattcaaaaaccatacattaagtatgtatcggctgggcgtggtggctcacacctgtaatccgagcactttgggaggccaaggcgggcagattatgaggtcaggagttcgagaccagcctggctaacatggtgaaaccctatctctactaaaaatacaaaaattagtcaggcatggtggcgcgtgcctgtaatcccaactactcaggaggctgaagcaggagaatcacttgaatccagaaggcagaggttgcagtgagccgagattgcaccactacactccagcctgggcagcagaatgagaccccatctcaaaaaaaaaaaaaagtatgtattatgtgctaggtactgggaatagaaaaaataatatatagcaggctgccctcaagatgctcagattgggatgagaaaaatatttatgaacaattacaatagaatgtgataaaaattaatttaggctgtgcccacagtgtatacatagtaatcagagagtatggtcagttttggttctgcttttagaatatgtgtttggagtcaccagagatgtgacccctaaatgcttcatgctgattattagcctactaaaggaaaaactatggagaggtgaaggacgctctgcatttagagggcagagagcgggttgctgtggctcacatctgtaatcctagctactttggaggctgaggcaggaggactacttgagcctaggaatttgagacgagagtcagcaacagagagacatgtctttaaaaacaaaacaaaacccaaaaagcctaattcagtcaaagcatgggtagaagccagattaagaaggttgagcagctgggtgggtggctcacgtctgtaatcccaacactttgggaggccaagctgggaggattacctgagcccagcagttccagatcagcttgggcaatacagtgagacctcatctctacaaaaaatttaaaaattaaaaaatcaccactaggattacaggcggtggctcacgcctgtaatcccagcactttgggaggctgaggcaggaggatcatgaggtcaggagttcaagaccagcctggcgaacatggtgaaaccctgtctctactaaaaatacaaaaattagctgggcatggtggtgcatgcctgtaatcaatcccacctacttggcaggctgaggcaggagaattgcttgaacctggacctgggaggcagaggttgcagtgagctgagatcacgccactgcactcctccagcctgggctacagagctagagtccgtatcagaataaaaaaaaaaaaaaagggctgggcaaggagcaggtgattatgaagtggtaaatctgacagtgaaaagtagttagaaaacaaagtggagatttttctctccaccctcacccacccactgagggtgtatgctcagggttttagggtatagaggtagaggcccagggaatgactgaataataataatggaagactcatatgatgcttactatgtgccaggtactattctaagcactttgcatatattaacttgtttcatacatagctgggcggggtggctcacatcttggctgagggggaggattgtttgagctcaaaagtctgagacgagcctgggcaacatggtgagatttcgtctctattaaaaatcaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatcaaaaaaattagctgggcatggcagcgcgagcctgtagtcccaactactcggaaggctgaggtgggaggatcccttgagatggggaaatcaaggctgcagtgagccatgatagttccactgcactccagcctgggtgacagaaggagaacctgtctcaaaaacaaacaaaataaaacaaacaggctgggcacggtggctcacgcctgtaatcctagcactttgggaagctgaggcaggcagatcacctgaggtcaggagtttgagaccagcctggccaacatggtgaaaccccgtttctactaaaaatacaaaaattagcagggcatggcggcggacagctgtaatcccagctactcgggaggctgaggcaggagaatcgcttgaacccgggaggcggaggttgcagtgagccgagatcgcgcccctgcactccaacctggtgacagagcgagactccgtcgaaagaaggaaaggaaagggaaagggaaaggaaagggaaagggaaaggaaaggaagagagagagagagagaaagaaaagaaaagaaaaaagaaaagaaagaaagaaagaaagaaagaaagaaagaaagaaagaaagaaagaaaacaaacaaaaacaaatagggattaataaataggcagaagcaggcataatccggggcaggggaagcctcggggccacgcccgagaggcatttgtattttactttcagcagttcagagcccatgatagccaggttacccacttgtggacttccttgaccacttaattgagtcaatctaaccctcaccttctctctcctctcactccatttagcgggtcacgtagccactagggcttccttagcctatcaggccacctggggactgagtcattcagtcagtcacctatctggtggtcacatctgcccctgggctcatccttttactgggccacctcggcccatcgggacctgtcagtccttgacctccctcaggcccctaggctggccaggtcgcctcagtgccacgcctccctggcccgcgattcagcctgcacgttacgctttgttcccagaagcaggttttcgaaacgcggttccctctcggctccagctgttttcctgccagcgctgggagacccggcagccgcagcgcccccagcggcgcgcagcggcccaggaagagagtgcctaccgccggcgcctcttcagcctcctcctggaacgcgggagcgggcgcgaccagcgcccaccctgatcgtcgcgacggtgctcctgattggctgcgctgtgtgacgtaacgggagggccccggcggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtacgcgagagccctccccgaccgcggaggaaggtcgagaaccgggtctgtcgaagagtgcttgtataggggggtggggcgcgcttgaacccatattccccgcattctgaaccaaattattttccagaaggccttcctaacagaaagctagtgtcaggatctgggtcactggataagaggatgcgttttttttttttccctctcacgaggctgtttctcaatgtgaagaggatgcgttttgaatgtttaacggtggttgcatagttaaaatgcacgctttttgcctttcgtgactttctctgggtgtaatactgatgcagggatttgttggtttttctaaaaacctcttttttttttttttttttgagacggagtctcgctgtgtcgccaggctggagtgcagtggtgcgatctcggctcactgcaacctccgcctcccgggttcaagcgattctcctgccttagcctcccgagtagctgggactactggctcacgccaccacacccagctaatttttgtatttttagtagagacggtgtttcaccatgttggcctggatggtctcgatctcttgccctcgtgatccgcctgcctcggtctcccaaaatgctgggattacaggcgtgagccaccacacccggccaaaaaccgtttttaagccatagacttctttgagaatctgaagatagccgagcactcaccaccccacccccacccccacccccacccctccccgccaaaggcacgtacacacaagtttgcacaccatcccgggtgcttgtactccctccagatctctgaactccaggttaagaactccaggactgcagcctttggaacagtcaaaaaaatgaaaatgctttagcgtttagaaacaaaaaaacctttaaccaaaatatcagaactgtatattgatactgtggtgccaagtttgaagcaggccagacaccaccacttttatagtacgttaattacaaagataagagaaggtgcattggcttcagcgaggatattttttggaaaatttattgcatattttctccccgaggaccattagtaggccagagatcagtctggttaatttccaaggtggaattaggctagaatgttattaaggaaaatttttgaatgacacttagttgtatcctagttcaatttcagacatgctttttgtgttaagtctaatgattttgtatttcttattttaaaattaacgcaaagtgaccaagcattctcttttccaagtgaaatacgttattttaattgattagttgctttaatttgccttaagcgttttagcagagatttgcttttattgttgtgtttgccctgtaacactgattttatcagaggtttcttttatttaaattatcccaaatttgagttgaaaagttgcctagaatttttaaagtaacaaactggccagttcgtttcttaaacatctattttaaaaggactgggtgttgatacagtttttccagggttagatgtttatgactttatggatttgtcgaccgggtattactctaaactttaaacattaaaagctattataattgaggacaccaactgtttgcatagtgggatagagatagaaaaaaaaaagccatgacagtataatgactacaagattaactactgaactaaatggactttaaaagtggggagaaagtgattataaatcaaatactgtataacaaagaccaggacaccaagaatctgattggtgaaacctgcggttcctggcagatgctggtagttgcagtcaactttgagcacaatataattccaatttaaggagttgagaatcttagaacccactgtagtgagatttgtaatatgactgaataaattcttcctctcgtttgtgagcgtgaattatataattaataccaggcattcattaagccatgcatatgcttatgttgaggtcatgagtactaataatacagctgtttcaaaaagcaagttaatgggcgggtgtggtagctcacgccagtaatcccagcactttgggaagccaagccgggcgaatcacgaggtcaggagttcaagaccatcttggccaacatggtgaaaccccgtctctgctaaaaatacaaaaaattagctgggcgtagtggtgggtgcctgtaatcccagctactcgggaggctgaggcaggagaatcgctcgaacccgggaggcggaggttgcagtgagccgagatcgcgccactgcacagcccgggtgacagagtgagactctgtctcaaaaaaaaaaaaggaaaaagttaatgacttgagtctccttctagaggaaggaaaagaagtatgccgcttctctctatccacagaatcgcctccagattttccgtacatgcatgcatcttcttagagaacaagcatgtaattctgtctttgccctctttcgtccttcctttactgcagctgtactaggctgctcacttattccctggtagccatccttccttactcatacctttgtacctttgcacctttgctccagctgttggctcttcactgactgccttaactacacctcactctccatctgttgaaatcctacctgttgttccagtcccctcacagattatagggcctttctctgaccctacccctcacgttcagctttgtttctccttctctgtgccctctgcctcaggcctgttgctttaatttagtttttcattttcctaggtatctctgaaggagatcaccatgctggttgaattagatcctgactgagtttactttgttatactgaatcttcgaattgccactcccaagcctggttttcatggcttaggtttaacatgttattagccttttatagaaagctagtgactactagagcctgggccaaacggaaaactcagtgtaatgcttcttcgcatcccaaacagggtacatttagtggcttaactttgcaggcatcaaaactgagcttttaaagccagagtttcatgcctcttggctaatattttggtttatcttgcatagctaaaatttgtaacaataatgtcctactcgaaatttaaggactggtggcttgcattgttatagtcttatccttttcattagaatgcttcataatttttaattttatatttttattcaaatgtttataagagaattataacccagtgtaacccagtgtaggtactgggaaagatgtgtgacagacatactttcttcctgtggaactcctactgtagtggagaagacagactgaaaagtagaaaaataaagtactagtaagatcaatatacaggagggacctacctggggtggcgtggtcagagaaagcatgaagctaagacctgagggtaaagaagaacccagcctaggcaaggcttggcctgagaggaggagaagagccttccaagtttagggaaaagcttatgtagatgtcctgaggtgagaaagtccattgtgttgggagtgtgtttcttttctttctttcttttttctttttttttttcttgagacggagtcttgctctgtcgcccaggctggagtgtgcgatctcggctcactgcaagctccgcctcctgggttcacaccattctcctgcctcagcctcccgagtagctgggactacaggcgcctgcaaccatgccgggcaaattttttgtatttttagtggagacggggtttcaccatgttagccaggatagtctcgatctcctaacctagtgatccgcccgcctcggcctcccaaagtgctggaattacaagtgtgagccactgcgcccggctttttttttttttttttttttttggtagatgacgtctcactctgtggccaggctagagtgcagtggcccaatctcggctcactgcaacctctgcctcccaggttcaagtgattctcctacctcagcctcctgagtagctgggactgcatgggactacaggcacccgccaccatgtccggctaatttttgtatttttagtagagacaaggtttcaccatgttggccaggatggtccctatatcttgacctcatgatccacctgcctcagcctcccaaagtgctgggattacagatgtgagccaccctctccggcctgggagtgtgtttcttaaaggagaaagggggacatataaaatgagtttggagataaagatcagggtcaggaattgggtttttatttaaagtgctgtgggctccaaggaaggaatttgaggcagaggagtgacctggggctgttattgtaatccagctacaaaatgatggtgactaatagtgacagtggagctgtgacttggagatgcctattttggagataaaattgatttgctggtgggtggggatgaagggaaagggaagaagggatgatttggtctatttgtaactttgttatcttctgtgtttttatctttaactgctttttgtatttgtggtattcctatggtggattttattttatttatttttttgagaccaagtctccctctgtcccccaggctgtagtgaagtggcataatctgggctcactgccacctccgcctctggggtttaagattctcctgcctcagcctccctagtagctgggattacaggcatgcactgccacacctggctaatttttgtatttttggtagagacagggtttcaccatgttggccaggctggtcttgaactcttgacctcaagtgatccacctgcctgggcctcccaaagtgctgggattacaggtgtgagccactgcgcctggcctagctctagtgtatttttatttaataagggctgtttccagtttaacaacagaatgcttcagaaggtagcttgctttgtttgacattttccatttctagcttgtgtcgatagataaattcaggctatgaagaaaaattagaataaataaaattttaccattaaaaactaaaggaagttggcccttcaagaaaataatgtactgtactcagcagactttgagcattacatgtacctggtaatatggaaccaacattgaatcagacagccctatcatgcttctgaggagcttactggttactaaaaaaaaaatttttttttttttgagacggagtcttgttctgtcgcccaggctggagtgcagtggcgggatcttggctcactgcaagctccgcctcctgggttcacgccattctcctgcctcagcctcttgagttagctgggactacaggtgcccgccaccatgcccgggtaactttttgtatttttagtagagacggggtttcaccgtgttagccaggatggtctcgatctcctgacctcgtgaaccgcccgcctgggcctcccaaagtgctgggattacagttatgagccaccgcgcctggcatttttttttttttttttgagacagagtcttgctctgttgccaggctggagtgtggtggtgcaatcttggctcactgcaacctccacctcctaggttcaagtgattctcctgcctcagcctcccaagtagctgggactacaggcgcacgcgctaccacacctggctaatttgtgtatttttagtagagatggggtttcaccatgttgagcaggatggttttctgtctcttgacctcaggggatctgctcgcctcggcctcccaaagtgctgggattacaggcgtaagtcaccgcgcctggctactaaaaaaaaaaaaaatgtaaaggttggctgtgctcggtggctcgtgcctgtaatcccagcacttcgggaggttaaggcaggaggatcgctagatcccaggagtttgagaccagccctggcaagatagtgagaccccattcccacaaaaaattaaaaaattagctgagcatggtgtcatgcgcctttaagtcccagctacttgggaggctgaagtggaaagattgcttgagcatgggaggtcgaggctacagtgagctatgatcatgccactgcacttcagcctgggcaacagagccagaccttgtctcaaaaaatgaatgaatgaatgaatgtaagttgtatatatttaatatatttaatctccatgcatggtgaaacagctgtgggagaactgagaaagggtgcttagtctaacctgagagcccagaagaggagcctcacacacctgtgaagtagaagccaatccctgaagggacaggaggaaacaagaagcatggttgtgcctcctctttacatcccctgttctaattatttaagaactcaaatctagacttccataatttggaatggggaaaggattgccagtaattttaatcagcatagaattcaactctgtgaataaacccctttgcgtttctcctgaccagtagttaaaatcatgtgaatttgattcagagaaaaatacaagaacatggccaggtgcagtggctcacgcctgtaatcccagcactttgggaggccaaggtgggtggattgcctgagtgcaggagtttgagaccagcctgggcaacacggtgaaaccctgtctctactaaaatacaaaaaattagctgggcatggcggcgtgtgcctaagaggctaaaggcaggagaatcacttgaacctggggggtggaagttaaagtgagtcgaggtcgtgcagctggactccatcctgggcgacagagtgagactctctccaaaaaaacaaaaaacaagaacactgtcatgctgagaatggaatcttgtccaattaagagttgtgttcccagccggatgtggtggctcacgcctgtaatcccagcactgtgggaggcttaggcgggcggatcatgaggtcaggagatcaagaccatcctggccaacatagtgaaaccccgtctctactaaaaatacaaaaactagctgggcgtggtggcatgcatctgtagtcccagctactccggaggttgagacaggagaatcgcttgaacctgggaggcagaggttgcactgagccaagatcacaccactgcactccagcctgccaacagagcgagactccgtctcaaaaaaaaaaaaaaaaaaagagttgtgttcccatggaaagtactagtagccattcgatttgtgacttttaaaactcaaatccacagaattgtgacctaaatttttccttttgatctgaatgattagactagatttctgagggtctttaagattaaaatattttaattctgggccgggcgtggtggctcacgactgtaatcccagcactttgggaggtctggcaggtcgggagttcgagactgaacctgggaggcagagatgacagtgagccgagattgcgccagcgccactgcactccagtctggtcaacagagcgagacttcgtctcggaaaacaaaaaacaaacaaacaaaaaacattattttaattctttcagataagtaaaagggggcacagcctattagttgggagttcagattaacttgagttgaatctgagctaaaatcataacaagttgggtggggccaccaggcacatagcaactcacctggaatgaacgtgacaagaacagtggaagaggatgagaagaggctttgaaggtgcacactcaacggtattcgaattctgtcacaccagttttgtgacagtattaaaccagagttaggtaatttgaatacctgagcttttgtgctttcagaaacaaaaaaggagggaaataggaaagggaagttctttgatatatagaggcctacaatataccaaagctcactgctagactcttggaatctaatggaagtaaaccatgtttttgtttttgatttttgtctttgagaagctttggtctattgaaaaaattagaatgccatgacagcttaaaagcaaaggcaatcaactgtacctaagaggtggggagaggcttgaaagaggagatgctcttcaactgattctttaaggatgagaacaagtatacgaggtagaagaggtggtggtagaagagatggtggcagtgcttgctggtaaagacacagttataattaatgtagatgatgggcaggaacctaggaaggaaagataaagccaacttgtaaagggcctcctcagccttgtaaatgagcttaacaatgggagccatctaaagtttttaaaaagagaactgtcagattttaaaaggagaactgatgagttttacttttgagaaactgctctgggtggggaaagatctgaaggactaattctctgttactggagagggaccctgagaagctgagccaagatcaaatgccataggaatgtaaagtggcacatagaaggtgaggggagaggtatgatgacttcagagaggattgagtggtgcctttgagacaagagaaagggattagggtgggtgcgtgattcttttcaacaggaagaatctttctttgaggtacctgctggaagccaggtggtatttagcaatctgatgggtttgttattgagaagagaggtaagggctgaatacatatagatttgggaatcgcagcttagatgggatcacccagaatgaggaggcagaacaggaataagtagagaaagagaagctgcggaaggagaggcagccacaagcataggaggaggagccattagtgatggcctgaaagcccagggacagaagggaggggacctgggcattaaatgctggtcagtgataaagaatggtggttactggctggacatggtggctcacgcctgtaatcctagcaccttgggaggcggaggcaggtggattgcctgagctcatgcgttcgagaccagcctggccaacacagtgaaaccctgtctctactaaaatataaaaaattagccaggcatggtggcgtgcgcctatagtcccagctactcgggaggctgaggcaggagaatggcttgaacctgggaggcagagattgcagtgagccaagatcgcaccactgcactccagcttgggtgacagagcaagactccgtctcaaaaaaaaaaaaaaaaaaaaaaaaagaatggtggttaaagcagtttcactagagaagtacttagctcatcttggaattgaattttttttttttttttttgagacagtgtcgctctgtcgcccaggctgaagtgcagtggcatgatctcggttcactgcagtctccacctcccgggttcaagtgattctcctgcctcagtctcctgagtagctgcgattacaggcgcccaccaccatgcccggctaatttttgtatttttagtagagatggggtttcaccatattggaccaggctggtctcaaactcctgacctcaggtgatccaattgcctcggccccctaatgtgctgggattacaggcatgagccagtcaccacgcccagctggaattaagttttctacctttttttttttttttttaactgtgaaatatttcatacatagaaaagagtaagggtgccgtggctcacgcctgtaatctcagcacattgggaagccaagacaggtggatcacttgaggtcaggagttcgagaccagcctggccaacgtggtgaaaccctgtctctactaaaaagacaaaaattagccgggcgtggtggtagatgcctgtaatcccagctacttgggacgctgaggcaggataattgtttgaacccgggaggtggaggttgcaatgagttgagatcgcaccattgcactccagtctgggtaacagagcaagactctgtctcaaaaaaaaaaaaaaaaaaaaaaaaggaaaaagagtaagcctgggcacgttggctcatgtctgtaatcccagcactttgggaggccgagggaggcagatcacttgaggtcaggagtttaagaccagcctggccagcatgtgaaacccatctctgttaaaaatacaaaattagcccggcagtagtggggccctgtaatcccagctactggggaggcttaggcacaagaatagcttgaacccaggaggcagaggttttggtgagctgagatcacaccactacactccagcctgggcaatagagtgagactctgtctcaaaaaaaaagtatatgtaagctgggtgtggtggcatgcacctgtagtcccaaatagtggggaggctgaggtaggaggattgcttgagcccaggagttcaagaccagcctgggcaacataaacccccatctctgcaaaaaattaaacaaggattggctgggcatggtggctcatgcctgtagtcccagctacatgggaggctgaggtgggaggatcacttgagcctgggaggtcaaggctatagtgagccatgatcgtactgctgcactccagcctgggccatagagcaagacgctatctcaaaaaaatttacaaaacaagccaaaaaaaactatcatctgtgtgctccctttaaaaaataaataaataaaacattggccaggcgtggtggcccagactgtaatcccaggactttgggaggctgaggtgggaagattgcttgagctcaggagttcaagaccagcttagacaacatggcaagaccctgtttctaccaaaaatacaaaaattaatcggatgtggtggcatgcacctgtagtcccagctacacagaaggctgaggtgggaggatcgcttgagccttggaggttgaggctgcaatgagccatgattgtgcctctgcactctagctcgggcaacagaacgagatcccatctcaaaaaaaaaaaaaaaaaaaaaaaaaggaatattaccagcacctttgaaacttcctttttctagaagttgattgtattggttcttagcatgcataaggagattttaagcttagaacatattagcacttggtttaaagatgttttgtgtatggtttatacatgtagaaactgagaacgcttttaaccaaaagagctgagagattcgttatcatcagaaaagaaaagtcagttacgaattagttgttaggggctttgctgctcaaagtgtgtagtggacaataggcaaaaagtgagaagcatggtcaagggtgtttggatgggcttgaaaaccctgtgcattttattttattttattttatttatttatttttgagtcggagtctcactctgttacccagactggagtgcagtggcgcgatctcggctcactgcaagctctgcctcccgggttcacaccattctcctgcctcagcctcccgagtagctgggactacaggcgcctgccaccacgctcagctaatttttttgtatttttagtagagatggggtttcactgtgttagccaggatggtctcgatctcctgacctcttgatccgcccgccttggcctcccaaagtgctgggattacaggcgtgagccactgcacctgccttatctatttaattttttgagacggaatctctgtctgtcgcccaggctggagtgcagtggcatgatctcagctcactgcaacctccgcctcccgggttcaagcaattctcttgcctcagcctcccaagtagctgggcctacaggcacacgccaccacacctggctaatttttgtattttaatagtgacagggttttgtcatgttggccaggttggtctcaaactcctgacctcatgatccacctgcctcggccttccaaagtgctaggattgcaggcatgagccactgcgcctgggcaacactttatattttaaagggaagttgggggagggtgctattttcaaccttgctcaaagaacaaataattgggaagcaataaattttctgatgaatatgcttcatatttctttagacagtggggtctaatggaaaggctaagatatctgacatggagcaacatgtatttatctcttcagtggaactaatgtgtaattttcaggggagtttgatgaataaatgagtttgagaatatagggcagaggacttggaatttgtgtcagggttatggctggtgagattgatttggtgtcaaatttatgaatatctctgcagatactaacacagaaaatgagccccaaggtcactatagcagtatagtagtggagggaaatagaaactatctttatcaaatttctacacagacatacccctcaccagggaagcaaggaagttgaaaagcacactttgcctccctaacccaggaatttagatgggggatcagcaaactgttgagtaaagggtcagattttaaatattttcagcttttccatagagtctctgtccaactactcaactatgcctttgtagtgaaaaacagtcatagacaatacgtaaatgaatgggcttggctatcttcttttttttgtttgtttttaagatggagtcttgctctgtcacccaggctggagtgcagtggtgtgatctcagctcattgcaacctctgcctcccaggttcaagcaattctcttccctcggcctcccaagtagctgggcctacaggcgcacgccaccacacctggctaacttttgtatttttagtagtgacagggttttttgtcatgttggccaggttggtcttgaactcctgacctcaagtgatcctcccgcctcggcctcccagtgttgggattacaggcgtgagccaccacacgcctggctttttttttttttttttttttttttttttgagatagagtcttaactgtttcaggcagtgacgtgatcttggctcactgcaagctccgcctcccgggtttacaccattctcctgcctcagcctcccgagtggctgggactacaggcgtgtgccaccacacctggctaattttttgtatttttagtagagagacagggtttcaccgtgttagccaggatggtctcaatctcctgaccttgtgatccgtccacctcagcctcccaaagtgctgggattacaggcgtgagccaccacacactggctaactgcttttaactatacaaataataaaatactcttggatggagtctaaggtggaactgactgtgctcttaatagtgtctgaaatttatatggtacttactggactgttcacaggctctctgtggctcttgaaatagcaggggctgggtgtgatggctcacacctgtaatcccaacactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaaggctgattagctcattatgagtgaagagtttagaaccagactccctgagtgcaagtctaacctcttctttggctcctcatttgtaaaatggggataataacagcatctacctcacagactattaaataatccaatctcttcaaagatcgtaaaccatgcctagcatagataataagtatgagctctttattattactcttgctcctactactcttgctagctatttatttttatttttattttattttattttatttttttgagacggagtctcgctctgtcacccaggctggagtgcagtggtgcaatcttggctcactgcaagctccgcctcccgggctcacaccgttctcctgcctcagcctcctgagtaagtgggactacaggcacccaccaccatgcccggctaattttttgtatttttagtagagacggggtttcaccgtgttagccaggatggtctcgatctcctgacctcatgatccgcccacctcagcctcccaaagtgctgggattacaggcatgagccactgcgccggcctcttatttatttatgttttgagacagtcttgttctgttgcccaggctggagtgtaatgatgcagtcatagctcactgcagcttctaactcctgggctcaagtaatgctcctgcctcagcctcttgagtatctgggaccgcaggtgtgtgccactatgcccggctcattttttgtctgtttagtagagacagggttttgatatgttggacaggcaggtctccaagtcatctgcctgccttggcctcccaaggtgctgggattacaggtctgagccaccacgcctggtggatttattatttttaatttggcaagtctgtaagcccttttttgttccttttttttcaagaggccagaggcagaggcctttgtcattttctgtgtgtccagggaagtgtgcaggatgtaagccatagattaggactgggaggaagagtgtgtggtggttgtgacaagggtccaaaggaaggcagcttccgaacttacttgagattataaaaataaatttaaaccaggtatctctgtgtaatcaaaaggtttctgtaaaacagagatggagtgtatgtgtgtgtgtatacttgtaatttgaaaagacattcagaatagtaacttttgggacagtacagactacaaaaattacaacatgatagaaccttcttaactactaagaatatagaaaggaaaataaagccaggcgtggtggctcacacctgtaatgacagcactttgggaggctgaggcgggtggatcacatgaggccagcaggagtttgagaccagcctggccaacatgccaaaatcctgtctctactaaaaatacaaaatttagctgggtatggtgttgcacatctgtaatctcagctactcgggaggctgaggcagaaaaatcacttgaacacgggaggtagaggttacagtgaactgaaattgcgctactgcactccagcctgggtgacagagcaagattctgtctccaaaaaaaaggctgggctcagtggctcacacctgtaatcccagcactttgggaggccgaggcaggcagatcacgaggtcaggagatcaagaccatcctggctaacaaggtgaaattccgtctctactaaaaatagaaaaaattagcggggcgtggtggcatgtgcctgtagtcccagctactcaggaggctgaggcaggagaattgcttgaacttgggatgcagaggttgcagtgagctgagatcctgccactgcactccagcctgggcaacagaacaagactccatctccaaaaaaaatgtagaggccgggcatggtggctcatgcttgtaatcccagcacgttgggaggccgaggtgcgtggatcgcccgaggtcaggagttcaagaccagcctggccaacatggtgaaaccccttctctactaaaaataaaaaaagttacctgggcgtggtagtgggcgcctgtaatcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgattaaggaagacccatgacctagaggcaaaatcaacatatatggttctgtatttctaacattggaatcagttgagaaatatgaaaatgtcttagaatttctcttgagcttggtagaggaatgaattttttttttttttttttttttttttgagatggagtctcactctgtcgcccaggctggagttcagtggctcaatctccgctcactgcaagctccacctcctgggttcacaccattctcctacctcagcctcccaagtagctggaacgacaggcacccgccaccacgcctggctaatttttttgtattttcagtagagacagggtttcaccgtattagccaggatggtgtcgatctcctgacctcgtgatctgcctatcttggcctcctaaagtgctgggattacaggtgtgagccaccgtgcccggcccaggaatgattttttttgagatggagtcttactttgtcacccaggctccagcacagtggcatgatcttgcctcatggcaacgtctgcctcctgggttcaaatgattatcctgcctcagcctccttagtagctgggattacagatgcctgccaccatgcccgtcgaatttttgtatttttagtatagatggggtttcaccatgttggccaggctggttttgaactcctgacctcaggcgatctgcctgccttggcctcccaaagtgctgggattacagacatgtgcgaccacgcccagccatagaggaatgattttaaaatacatcagcccttgcttgttatggattttgtaaattagaatagcatgaaatagaacttgaacattttaattaccaagtcattttcttttcttttttttttttttgagacagagtctcgctctattgccttgttgcctaagctggagtgcagtggcgtgatcttggctcactgcatcctccgcctcctgagttcaagtgattctcctgcctcagcctcccgagtagcggggctacaggcatgcaccaccctgcccggctaatttttgtatttttagtagagacggggtttcaccatgttggccaggctggtctcgaactcctgacctcaggtgacccacccaccttagcccgcaagtgctgggattacaggcatgatccactgcacttggccaagtcattttcttctaactaaatattactttttaaaaaaactctttctcagctgggcacagtggctcatgcctgtaatcccagcactttgggagggcgaggctggtggataacttgaggtctggagtttgagaccagtctggtcacagacatggtgaaaccccatctctaccaaaaaatacaaaaatgagccagacgtggtgggcatgcacctgtagcctcagctactcaggagactgaggtggaacaattgcttgaaccaggtaattagaggttgcagtgagccgagatcatgacactgcatttaagcctgggcaatagggtgagaccctatctcaaaaaaaggggggagaatgttgagagagagcctaagtgcatttcagaaggatgaagtaagggaccctcttgcttcaaaaaaaccaaatcctgactcaccaaacagcctgcccacagataaaagttagctagaattggtttcatgggtatttttccataggttgtcctcagtgtttttttgtttttgtttttgttttgttttgttttgagacggagtttcgctcttgttgcccaggctggagtgcaatggcacgatctcggttcactgcaacctccgcctcctggattcaagccattctcctgcctcagcctccggagtagctgggattacaggcatgtgccaccatgcccggctaatttttttgtatttttaatagagacggggtttctccatgttggtgaggctggtctcgaactgctgacttcaggtgatctgcccacctcggcctcccaaagtgctgggattacaggcgtgagctaccatgcctggccctcaagtttttctttggaccagtagtagtatctgaatgaactgcacctgaaggtttgtttcaatgtttgattttttgcctccctttcatgttggctataaggaaaaggagcatttgaggctgtggtgggggtcagggactgagaggctccaggtctcaggaggctgcctccacagataggagtgctggctgagcaggccttccagctttctttccttttttttttttcgagatggagtctcatttgttgcccaagctggagtgcagttgatagaatctcagctcactgcaacctctgcctcctgggctcaagcgattcttctgcttcagcctctcaagtagctgggattacaggtgcccgccaccatacccaactgtttttagtagagaccgggtttcactatgttggccaggctggtcttgaactcctagcctctgatcatctgcccgcctcagcctcccaaagtgctcggattacaggcgtgagccgctgcacctggccaggccttccagctttctcacccacacacagacctgcctaggcacaggtgcatgcctctggcctggtctatgcctcagcaccttggtgctctgggctgttaataccctgtagcatgcattgtgttttcagccttttgaggcattttcacgtccatcatagcataggattggggagctaggagtcagagtgggtgtgactcgtgtgtgtttggcagctgctcgttgagaaccttgaaagtcgaggctcccagtcagaattttaggtacctgcctgttgacctctggctctaggatgtgtgttttagaaacctgtatctagtgtgcgtgcgtgtgtgctcactggagcgagtactaggaggttgtagggaggaataccaggtattacagaagggatcacttagagcttggtgagtgggtggataagtaggtgcctgagagaggtcaggagtaggaggaaggaagcctggttaatgattgtgtattttaagataacctacatacttggccatacatagttcctagtctctctggccccagagagaggttctccacacctgagcctcatgacactaacccagccagctgagcttcagccaagggtttgtttggtgcttgactgagagagaatgtaaatgggacctgagaaatagacctttaccaaattccatttagtggtattttgctttctgaatatttaaatgaaactttaggttatagcataagtaaatttttttttttttcgagactgagtctctgtcactcaggctggagtgcagtggcatgatctccgctcgctgcaacctccacctcacgggtttaagcgattctcatgcctcagcctcctgagtagctggggtaaatgtttttatgattgttatcttctaaaactattattaggatagtggtgcctgtctgatcttgttaaaaacaactcttgggacttttgcaattaggttactaggaaaagtattaaaattaaaatgagaaacagacaagtaggacaaaatgtgctgataattgaagcttcgttattcccctagatagtattacagagaatgatgatggcttaggtgactttattccttaaattattttacaattttttttaatcttgattttcaaaagaggattcctgtaagtaaagagatattttaaaaccagtttgtgtttagctattttcttttcttgctgacttttctgcaaggaaagagttgatcctgagatttgatttgaaggggaatacttggtatctgtaaggtgagtagagcttgtgtgatgagactaacgtcactgaatagctgtagacaggtgagcatgctgggcaaagggcaaaagtggcaaaagacagccagggcagtgggctgttgccatatcacgaagggctgagctgaggagattaacaattttcttgcattgccttcatttgagtcatgaaacagccagtttctcacaactgacaaggtcaggtttacaggcaatttctttttatatattaatttttaaatttagagcaaatgcttgactgtcatgtaataatatcattctcattcatttgcattccagtatgcttttctgactaaaacggaagaaatagcaactttagaattgtacttaaccctgggtacacacacccatgactatttgtatgaaaatttgtatttaagtgtctaaatgcagcctcacctgtgcttttcccccatggtgtggcataagaaaacaattggtgacacaagctggggatctgtgggaattgaagtcagtgaaacagatcgtgtggaggaaaaatagtttcccaggcttacaagtgagacttaaagtgatttgggatggaattggtataaatcaagcagaaaggttgtattgataccttaggtcatttagttcaatcattttccctgtgcttttagccctcttcagagtctaactccatggccctccagtctcaacttggacacctccaaaaaaacattcacttcaacaaaagtttattgagtgcctattatgtgacaggctaggaacttgggatacagtagtgaacaaaacaaagatgtatttcctgtggcacatctggaacataagttgctttttttttttttttttttttttttgagacagagtcttgctctgtctcccaggctggagtgcagtggcgccatcttggctcactgcaagctccgcctcccgggttcacgccattctcctgcctcagcctccggagtagctgggactacaggcacctgccaccacgcccggctaatttttttttttgtattttttagtagagacggggcttcaccgtgttagccaggatggtctccatctcctgacctcgtgatccacctgcctaggcctcccaaaatgctgggattacaggcgtgagccaccgcgcctggcccataacagtttcatgaggtggtctgtctcatgttgtatggctgtggtagctgacaagtcttgtgttctggctctccaccagggagaaagaagccacagccaagtccccttcttgtgtttgcctagcccagtgtgtggacttaaaagtgcatggccccatagttgtccctcttgagttttgtagttttgttgttggtttggtttttattggtcttgtcatatgatctgcgtacatctctgaatccttttttttttttttttgagttgaagtctcgctcttgtcgcccaggctggagtgcaatggcgtgatctcggctcactgcaccctctacctcccaggttcaagtgattctcctgcctcagcctcctgagtagctgggattacaggcacctgccaaccgcgcctggctaatttttttatttttagtagagaaagggtttcaccatgttggccaggctggtctcaaactcctaacctcaggcaatccgcccgcctcagcctcccaaagtgctgggattataggcatgagccaccacgcccagcctctgaatcttttaaaatcctggttatgtcatctagcatattcattaccctccagtttcctaactgcaggttttgtaaaagcaccaacagatctttgtactaaagtccttctatgcagcctctccagatctgcctcttatatctataaaaagacagtgaggttgatctggcgtgacttgttcttggtgggctcatgctgcttccagatgctccacttcccattctaaattctcacaaaccatctgttagctaatcgcatccagaattttgtctgggtttcatttcaagctcactgttttacattttatggaatttgccatcttttgacaaaaaacaagagacttgacccttcctaagtcttccagtgtcctgtgatgtaatttctctatgacaggagactagtcttggactcttactgctgtttgccagtgtgtttggtcagctcttaagaacaccctttcctcatctttggtgctccttttttttttttttttttttggcattttttttcttagtgatactcagcgttctttgaggtcaccagcatcctcaacattcttgctcttcattcccataattgctctgtgtcatctgtgattgcgtttttataatttcttcttggattgtctttgccccatttcaaaacctgtagtaatttggattacatctggtctctgtgtcttttgaattggccttcccaagggcccatggtacaacttcctttactgactgacctggaattatcagattcccactttaccaattggttttgcttcattgcttagaattaaatttgtattagcattttcttcattgctgcatctgcttgctgaggtgaagtaatctgcaaagtaagtttaggtttcattaatactgattggactttgtattggactcatgatgaatccctaagagatcatcatgagttcctcctgctgggtggcctgcagtgctcttggggctgtatgtgttcatcatgaagcatctgactcagccctgggggtccatgtggcaagcttacaggctcccagtgtaatggggcttctgtccctcacctcacgtcacattctagcaacgtgaagccttcttaccaaggcttcccagaaaggcccacaagttagcattcaccttaagcaagaatctcaggtgtgtccttcccatgccgtggtggtgtgtggatgtctggtgcccgaggaatcatttccacttgcctccttggacctttcatcaggactgaccaggatcctcctccacccttctgtctttgacattgtgtcagttgtccttcacagcatctcagctttatttctttagtaccaaaagtgctttttttccttgactataataccatgcaaatgtaggaatctttagaaagtcctttagaatattctcgtatttaaaaatatatacatatgtgtgtttgtgtatgtgtatatatatatatattttatgtgtgtgtgtgtgtgtgtgtgtgtgtgtgtgtgtgtgtgtatatatatattttttttttttttttttttttttgagatagagtcttgctctgtcacccaggctggagtgcagtggcatgatatcagctcactgcaacctctgcctcccgggttcaagcagttctctgcctcagcctcccgagtagctgggattacaggtgcccgccaccaggccgggctagtttttgtatttctagtagagatggggtttcaccaccttggctaggctgctcttgaactcctgacaacgtgagccactgcacccggcccagaaaaaaatatttttaaaaggtttttgttcctctttcctaatgtgtaaattaagtcagaatgccatggaattggggccctggtgtggttcaggcagggcctgtcccatcctggtcattaggctgacctctgttttctgtgatagctgttctctggtgatagctgttgagtaagaagaaccatcagctaggggttcacagagagaagtttattctcatgactgctcccacactaagagcttgaggtttatatagtttgccaactatctaccttctgtctatgaatttacctattctacctacctgatataagtaaaatgatacaatatttgtcctttgggtctgaattatttcattgggtacaatgttttcagagttcatccagattgtagcatatatcaaaacttcatttcttgtcccagcatggggtgactcacacctgtaatcccagtgctttgaaaggccaaggtgggaagatcacttgaggcaaggagtttgagaccagcctgggcaacatagtgagactccatctgtacaggaaattatgataaagacttcattcctttagggctgaataatattccattgttatgtatatatcacgttttgttaatccatttatctcttgatggatacttgagttgttttcgttattttggctatggtgaataatgctgcagtggacattgacacacaaatgtttgagtccttgctttcagttattttggttatatatctcagagtggatttctgggtcaaatgggtaattctgtgtttagctttttttttttgaaacggagttttgctctgttgcccaggctggagtgcagtggcaccatctcggctcactgcaacctccatctcctgggttcaagcgatttctcctgcctcagcctcctgagtagctgggattataggcacgtgccaccacacctggctaatttttgtattttttagtagagacagggttttgccatgttagccaggctttgaactcctgacctcaactgatcgctcacctcagcctcccaaagtgctgggattataggcatgagcctcctatgtttagctttttgaggaactgtcaaactattttccatagcagctgtaccatattccattccaaccagcagtatataagggctcccttcttcaccgccaaaaaaaaattcttccacatcctcatcaacacttgttattttccatattttttattatagccatcctagtaggtgtgaagtggtatgtcattgtggttttgatttgcatgttcctagtgactgatgttgagcatcttttcatattggcttttggcaaatctttggataaatattttcaagttctttgcccattttttaattgggttatttgagcgtttttgttttttattttgttttatattttttgagacagagtctcactctgtcgccctggctggagtacaatggcactcacgatctcgactcactgcaacttctgccttccagattcaagcaattctcctgcctcagcctcccaaatagccaggattacaggcactcaccaccataccccgctaattttttgtatttttagtagagatggggttttaccatgttggccaggctcttctggactcctaaagtgaggtgatccacctgccttggcctcccaaagtgccaggattacaggcgtgcgccaccatgcctgaccttagttattgtatttaggctgttgatccattttaaatgactttttgtgtatagtgtgaggtaaggtttcagagtctttcttttgcatgtggaaattggtgcagttgtcccagcaaggttattctttccctgttgaatagacttggcaccctagtcaaaaatcagttggccaagctgggtgtggtggtgcacacctgtaatcccaggtaccctggagactgaggtgagaagattgcttgagcctaggagttgaagatcagcctgggctacatagtgagactcccacgtgttaaaaaaaaatcacttgatcataaatgtgtgggtttatttttgacctctgagttctattccattgttctatatgtctctccatatgccagcaccacactgttgattactatagctttttgtagtaattttgaagtcaaggaagtgtaagtcctctaactttgatgcttttcaaggttgttttggctattcaggttcctcgcaattctatatgaatttgaggattggttttcccattgctgcaaaaaaaaaggctgttagaattttgatagggattgtgttgtatttgtagatcactttgggtagtattagctttttttttttttttttttttaatttcttttatgaggcagggtctcactatgttgcccagactggtctcaaactcctgggctcaagtgatcctcctgtctcagcctcccaaagtgctggcattacaggtgtgagccactgcacctagccaatattaatatcttaatcataagtctttccatccattaacacaaatgtttttgcatttatttaggtctttaataatttttggtatgcaagtgtttcaccatggttaaattattctcgttttgttttgttttgtttagacagagtcttggctttgtcaccaggctggagtgcagtggtgcaatctcggctcactgcaacctccacctccctggttcaagcgattctcctgcctcagcctcccaagtagctgggactacagacatgcgccaccatgcccagctaatttttgtatttttagtagagatggggtttcactatgttggccaggatggtctcgatctcttgacctcgtgatccacctgcctcggcctcccaaagtgctgggattacaggcatgagccaccgcacagcctattcttggatatttttattttagatgctattgtaaatggaatcacttttttttttttcttcttggagacagagcctcactcccgctccattgcccaggctagagtgcagtggcacaattcttgtgcctcagcctcctgagtagctgggactacaggtgcctgccaccacgcccagctaacttttttttgtattttagtagaattggggttttaccatgttgcccagcatgatcttggcgcctcccaaagtgctaggattcaggcatgagctaccgtgccctgcctggaattactttctttctttttttttgggatggagtttcgctctatcacccgggctggagtgcagtggtgtgatcttggctcactgcaagcgccacctcccgggtgcacgccattctcctgactcagcctcccaagtagctgggactacaggcgcctcctaccacgcccggctaattttttgtatttttagtagagacggggtttcacggtattagccaggatggtctcgatctcctgacctcctgatctgcctgcctcggcctcccaaagtgctgggattacaggcatgagccaccgcacccggcttggaattactttcttaattattcattaccaatatataagacgcaactgatatctatgtgttgatctcgtaccctgcgactttgctgaatttgtatcttttcttatatatatgatcgtgtcttgacttcctcttttccaaaagcccacatactcttgtaccacagcatactggcctgtgatacctttagccccgccccctacctttcccaaataaaatctctgtgttaaccagtaaacagccctcttgaatcaagttactactctgaaggatagtggtaattttaagaaagagaccaagtcttcagtattaaaaccctattagatagcattcagttgtgggtttgagtgtatgagattacttgactgctagccagggcacacagacagggagcctagccctcttaaagcctctatctctctggctactctgattcaggtgcaggtgcacagagaacacaggggcaggcagtggacccatgcagctccgtgagggccaggggtgtttgtctcctttgtgtcctctgttgtatctcttcacggcctacacatagatgttcaatatttgttgaatgactagaggaataaaagccacagagagcaggatgatacctgtctggtgattatagtacatgggctttgttttgttttagatattttgggggctataagcccctttgagaatccagtgaaagttgtgcagtcttcagaaaaacagcatacattcatgtatttgcatacaacttcgcaggatgttctttgatcactgagacccattcacatcactcaagttagaatttatgattccagtgtcaccagtgtactcctgatcttacttttatgtaacctgaaagcatacaatctcagcctatcagtacagggagcggagactgattatggaaccaaaaaactgctgtgacgaccagtgcttgggccctccagtgcgttgactgctctttgaatcaagtgccagatgccagtcagtagagtcatttcctggacaacactctggacaagtagggctgtaggaaactattgccagcagcaagaggtaccctcttgccatttaactcttggtagacataaaagggctgactagtgtccctggcatatgtgttttagagttaatgtgtccactccccaggtgctaagtgcggccagccacaaagatagtgttttgacagttctaataatgattaggattggcctgttccatagagtgaaaattaataaggatgatgcattaggtatgtgcttcctcttaatctgttgataaggtcagccacatctcccaggtgtagtttgccccgtgaactgagttggtatctacccacatcaagattggtctgccctctaagactatactttcagggatcatttctatagttcattactagagaagtttctctgaaggtgtagagcacccctccctccaaaaaaaaaaaacagattgatctgccctccacagtgagtgcttctttgagctggatccgtgtaccatgaacccagaggaagagcaccacaccagaatagggagtgatgagggaaacggcaagatggctgccaagctaccagccattttaggatctgagcacaagcactgtttggtagagccatggaagaagctggtccatagccaggcctgtaactggacagcaggctgcataacagccaggatatctttactgtgttgagatagaaaacagcatgaagaatgatgatggtgttttagcatgtggaaactcctgcaaggccacaatgaggcactaatggtcaaggggccaccagaagtctctcagccattctcttcctaggctgctctttgacctacttctgctggtccaggttccctctgtctaagcagtagctccttgaatcctgtgctctgcagcattgagttaatagtgtttttctgccacttgctgcttttatgtgttttctgtctctctctcttttttttttttttcaatagaagctaggtctcactatgtcacccaggctggtcttgaacatgtggcctcaagtgatcctcccaccttggcttcccaaagtgctgggattacaggtgtgagccactgcgcccagctacaccaagtgcagtgacacgattttggctcactgcaacctccacctcccaggttcaagtgattctcctgcgtcagcctcccgagtagttggaatttgggattacaggcatctgccaccacgcctggtgatttttgtatttttcagtagagatgaggttttgccgtgttggccatgctggtctcgaactcctgacctcaggtgatccatctgccttggcctcccaaagtgttgggattacagatgtgagccactgcgcctaggctttttcttttcttttcttttcttttttctttttttcatttttttttttttttttttttgagacagggtcttgctctgtcacccaggctggagtgcagtagtgtgatcacagcttactgcacccctgcaacctctgcctcctgcgcttaaacgatcttcgcacctcattctcccaagtagctgggactgcaggtgcatgccaccacgcctggctcatttttgtattttagagacagggtttcactgtgttgcccaggctggtcttgaactcctgggctcaagtgatccacccacttcagcttcccaaagtgctgggattacaggtgtgagccactgcgcccggccactttgtgcttttcacactatgttattatctgacaaagattcattgtgtatcccactcaaaagacagaagttttttaaggatacgaactgacctgcccattttccatggagtagatgttcagtaaatttatttaattgattaggtaggatcatgtagaaagtatcctgttgaagaccgccagactcacaagttaattggaaggcgtgaggtgtgagtgttcttggcagctttcaatccttagcctcatctttaatcttcccgtagtcttctttggctgcttagtatccatcacagtcatttattagaccccgttttcagcctgttcctcattggttttgagaggacccttgttggtgacaaggttggaaatcctctgatatatacagtgttgtgcttctcagtgctaattccagctcttcccttcgtgcatccaaagggtatgatcattagagggggcgtggggttgggggatgggttctattcaggaatctctactcaagtaacaatcatttaattactgcaagaacctttcaaagttggaaggaaactgagacttggagaacttaagcagtttgctacagtcatgtagtttctaaaagtggcagaaccaggacatttgtttggtgtcctgcatgctccaaagttcatggcacggaccattggactgtgccataaaaaccttatgcctgtttttattttgagatgtagtcttgctgcgttgcgccggctggtctcaaactcctgggctcaagcagtcctcccacctcagtctgccaaggacctggaactagaggcatgtaccacgatgcctggttctatatgtgtttaagcagacaaaagcttatttcttattgtcttagatcttaggtgggtcttatattcaagtagcgtttttatggacctaagtacacaatacagaaccttagattagtgctctgctgaacagagtaacaccctgtctacaatgactaccacctgaaggtctttttttaaaatacacctttttgtgtaatttgactttaaccattctcagaatcatgtgttcatttctatcctgttggggttagtggccaaaatagaaggttggtgtggggtggggagctgctttgtgctcaaaagctgtttctgtgtgtgtgtgtgttttgatttttgtttttttgagacagggtctcactcggttgcccagtctggggtgccgtggcactatcacggctcactgcagcctcagcctcatgggctcaagccatcctctcacttcagcctcctgagtagttgggactgcagtcatgtaccaccacacccggctaatttttctattttttagaagagatgaggtttcaccatgttgcccaggctggtctcgaactcctgacctcaagtaatcccaggagttcaaggttacaatgagctgtaatcgggccactgcattccagcctgggcgacagaccccgtctataaaaaattaaaaaataatgtgcatggtggtgcacgcctgtagtcacagctattcaagaggtggaggtggaaggatcacttgagcccaggcgttagaggttacattgagcagggatctcaccactacactccagcatggctaacagagtgagaccctgtgtctaaataataatgtatgggccctttggataaggtagtgtttgtgatttaatgtaaactgtctttttcttgttgcagagaaatgctaactttgtcttcttcatccatacaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctgcctcccagagtgtctgtcttgtaggtattgtatgggagcctagtgcttggccttctgagcatgaggcaatagttcccacaggttgcaccaccacagagaacttggatctttttccttctaggcacccatatctgaggcttctagtaaatatttcttcagcatgagctaaccagggttgaatggtatcaagcagaagtcatgggaagtgagcagcctcattgcaggtcagggcatgatatctgtgcggctttcttgaatccttttctgttcttggctgtaggtggttctcctgatgaactttgggagacctccaagtggattggcttgaggtgttgggaggcccactgacaccccctcagccagggccttgtctctcctactcccagctctcagtacattttatctttcacttcactgtactctattcccatgcctatttgtgtattttgaggtgcatattttcttgtaaaacctcaggaagccatttttaaaaattatggctggatgtggtggctcatgcctgtaatctcagcactttgggaggccgagatgggcagatctggagttcaggaccagcctggccaacacggtgaaatctcatctcggcaaaaaatataaaaatgagccaggcatggtgatgcaggcctgtagtcccaactactgtgcagggagggccaaggtgggaagatcttttgagcttgggaggcagaggttgcagtgagctgacataccactgcactccagcctgggtgacagaggaagatccttctcaccgccctccccgcccccacccccactaagacagtcttgctctgttgcccagagctggaatgcagtggtgtgacgtcacctcattgcaacctccacctcccgggttcaagcaattcttctgcctcagcctcccctgagtagctgggattacaggtgtgtgccaccacgtccagctaacttttgtattttttagtagagacggggtttcaccatgttggccaggctggtctcaaactcctgacctcaggtgagccacccacctcagccttccaaagtgttgagattacaggcatgagccactgcgcccagctgagaccctgtcttaaaaataaatttaccagcactttgggaggctgaggcactttggatcacaaggtcaggagttcaagaccagcctggccaagatggtgaaaccccgtctctactaaaaataaaaaaattagctgggcatggtggcgggcgcctgtaatcccagctactcgggaggctgaggcaggagaattgcttgaacccgggaggcagaggttgcagtgagccaagatcacaccactgcactccagccccatgggtgacagagtgagactccatctcaaaaaaaaaaaagttaaaaatttatttaagacagtgtcttgctcaggctggagtgcagtggtaagatgatagctcactgcagcctccaactcctgggcccaggcaatcctcccaccttggcctcctcagaagctgggattacaggcatgaccctctgtgcctggcccaggatatatatatatatatatatatagaactatgaggctaaaatgtccctggttcctactttcaggtttctgctgaatttgagagaagtctgtcttgaaatatcaaaactgtcacatcattctggaagaaacaatactccagagacatctttgaaaactacctttagagcctggtgcggtggtgcgttcttatagtcccagctactctggaggctgaggctggaggattgcttgagcctaggagttccagactgcagtgagttatgactgtgcctgcgaatagccactgcactccagcacggtcgacatagtgacacctattgagacatagtaggatctcaattttttttttttttttttttgagacagtgtcttctgcagtggtgtattctcggctcactgcaacctccacctcccaggtttaagcgattctcctgcctcagcctccccagtagctgggactacaggcttgcgccaccatgcctagctactttttgtgtttttagtagagagcaggtttcaccatgttgaccaggctgctcttgaactcctgacctcaggggatccgcccaccttggcctcccaaagtgctgggattacaggcatgagccaccacctggccagcatctcaatttttaataaataactaaaaaataacttgtttgaacaggtatatcttggccagcaatgctggactgggttcctttgaggtgagggaaactcttggacatgggacctagtgggggcctctgcttgcctccctgctgggttaacagtacagctggcccagccagtcttgaaaccttaccctgcaacaaaaacttgacacctccaggctggtaattctggaggtgtcttctctgccaagtcggtgactccccaacccgctattatggctggactctgctcttgcagtcttagtgtacaccctggttcttcaagggcagcaagcaggactattccggtagcaaccagagctggagctcagggccccgcactggaaagctggggcagcttaggtggtaactagtgtgctgaggatgaggggcgctatggagcccaggcgggtttaggaagcattcttggcttcctggaggaggggaaatactggtaattcaggctgaaggagctggatggggccaggggcagtgactcacgcctgtaatcccagaactttggaaggcctgagacgggagggtcgcttgagcccagaagttcgagaccagcctgggaaacatggcaagacctcgtctcaaaaaagccacgcgtggtatgcgcctgtgctcccagctgcttgggaggctgaggctggaggatcgcttgagccctggaggtcgagactgctgtgagccgtgattgcaccactggactccagccttggtggcagtgagaccctgtccccaaagaactgggtgatctcgaccctccacatcgctggctctccacgggcgctgcacagtggagacccaggatctgattgcataggactgggcactggagtttaagttctccaggggggtttaatatgcaacgaagttgggaaccactaccagtgaaccccttcattctgtgcggctccagctcccggaagccctcggacaaggaactgtagcccatgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgcgcccttacctggggctggggaggtggggacagagccgggcgcagtcgggggcacagccctgaggcggggctgagggccaggccgccacgtccctggaccctgaaaacgggctcggacccccgctgcagcgtggactccggtgtggccgcggggcgtgcaacccggaccctggccagctccgtgtcctccagacctttactcatgtccccgcatcgccaggccgagctgcaccttcggtccccgcccgcggcagccgaggtagggcatctccagcgccgactccggggaaggtggacatcgcacggaagggggtgaagggcagggaggatcccagcttgggatgggggtagagggtggcggaccttgcgcggggcgggtgtggagggcggcccaactctcgtggcccctggtgcttccgggagctccgtcctcgctctcggatcccaaggaagaacttgacctttccctgacatcctccagtgcccatggcttctggcgtccacggatggcggggaggggaggggggcgcattcagcgactgcagagactgggggctgtgggccggggcagctgcggggcggagggtggcgtgtggtggggttgggtggcgtggggttgcagaaggcggggcatggggcccaacggccggctgcgccgcccttctccgtatggctcttcggagccgttgcatttgccctctcagggcttcctgggctctcggccctaagtaacctgtgtcccagagtccctgagggaggcgcaggatcactgagctctgccctccctaagatggaagcaggaccgtgtggaggagggacggccgcatgggatggccagggtgggggccccaagaggacagcctccgcccgctcgcccgcccgccaaggaaagccctgggggaacacactttcaggctaaggggtctgaggaagagaagactaacaagggggaagccctcgagatgcccaacagtcaagtccgggaaggacggagtagataaccagtaactgcctagagggtgggagccaagaagaggaggggcctggacagggctgcaaggaggaagacacaggcccccatgccagccttctggaaacagcggtttgcagaccacctgagctcaccaagacagctctgaagaatttagggaattatgctttggcttctgggttgaaggaaaaaaatagctataggatgcagcattcaaaagacccgtaggcagggcgcggtggctcacacctctaaccccagcaatttgggaagctgaggcggagaggatcatgtgagccccagggttcaagaccagcctgggcaatatagtgagtctacaaaaaaataaaaatgaaaaaattagctgggcttggtggcatacctatagtcccagctactccacaggctgaggtgggaggatggtttgaacctgggagttggcccaggtgtggtggctcatgcctgtaaccccatcactttgggagactgaggcaggtgaattacttgaggttaggagtttgagaccagcctggctaatcatggtgaaaccccatctctactaaaaatacaaaaattagctgggtgtggtggcccacgcctgtaatcccagctactcaggaggctgaggccggagaattgctttaacctgggaggcggaggttgcagtgagctgagatcgcaccattgcactccagcctgggcaacaaagcaagactcagtctcaaaaaagaaagaaagaaagaaagaaagaaaggccaggtgcggtggctcatgcctgtattcccagcactttgggaggccgaggtgagcgaattgcttgagtccaggagttcaagaccagcctgggcagcatggcgaaaacctgcctctacgaaaaaatttttaaaattagccagccatggtggcacgcccactcctgtagtcccagctactcaggagaatgaggtgggagggtcacctgagcccgggaagtgaaggttgcagtgagccgtaatcgcaccactgcactccagcctgggcaacagagcgagaccctgtctcaaaagaaaaaaaaaagaaaatatttaaaatatttaggcccagcatggtggctcatgcttgtaatcccagcactttgggaggccgaggcaggcagattgcttgagctcaggagttcgagatcagcctgggcaacatggtgaaaccctgtctctaccaagaaaatacaaaaattagctaggcatggtgacaaatgcctgtagtcccagctactccggaggctgaggtgggaggatcccctgagcctgggaggtggaggctgcagtgagctgtcatcacgccactgcactccagtctgtgccacagagcaggaccctgtatcaaaaaaaaaatatgtatttttaacacaattacaaaacactgtttataattaaaaataataaaatgtttgtaataaaaaaactttttcacggcagaataatattccactgtgtggactgagacagctggttttgtttgtttgtttgtttgtttttgtttttgtttcattttgttttttgttttttttttagacagagtcccgctccttcgcccaggctggaatgcagtggcgcgatctcagctcactgcaacctccacctcctgggttcaagcaattctcctgcctcagcctcccaagtaggtgggattacaggtgcccgccaccatgcccagctaatttttttttttttgtatttttagtagagacggggtctcgccatgttggccaacctggtctcgaactcctaacctcagatgatccacctgcctcggcctactaaagtgctgggattacaggcatgagccatcacgcctggcctgagacagctcatactagctcatcggtcactgggagtgtggagcttgttgtcaatcgtgtgtgtgtgtgtgtgcacgcacgcgcgtgtgcgtgtgtttagagagggggttttgtcatgttgcccaggctggtcttgaactccagggctccagcaatcctcctgccttggcctcccaaagaactgggattacaggtgtgagccacgctcctggcctgttgccaaattgatgatagaaattcctcatggggtctaattaagtgccacagggacagggctaccctgcagccctgtgggctagctcttgcccagccctcactgtaggagtcctctgacctcttccgcctacctcttgcctccttccagtccaacaccagtcttagatttctttcctgaagacacatgcaaccgggcacagtggcatatgcctgtagtcccatctacatgggagaatgaggcaggagaatcccttgagcctaggagttcaaggctgcagtgagctatgatcgtactcctgaactccagcctgggtgacagagagaaaccccatttcaaaaacaaaacacatgtgatgaagactccttacccagctccccctgttcctccagaccagccaacctccatgccaggcccctgcccagaacttcatggcaagctggactggactggcatattctgagttctccagaatttaccatcttacctccttgcccacactgtttcttctgtgtgaatgcccttttcctctcctatgaacacctacgggcatctgccctcagctcctgccacctccctccatgagaacagggattaagactggctatccctcaccaggcgcggtggctcatgcctgtaatcccggcactttgggaggccaaggcaggcagatcacctggggtcaggagttcaagaccagcctgaccaacatggagaaaccctatctctactaaaaatacaaaattagccgggcatggtggcacacgcctgtaatcccagctactcgggaggctgaggcaggaaaattgcttgaacctgggaggcggaggttacggtgaccccaaatcatgccattgcactccagcctgggcaaaaagagtgaaactccatctcaaaaaaaaaaaaaaaaaaaaaaagtccgggcgcggtggctcacacctgtaatcccagcactttgggaggccaaggtgggcggatcacaaagtcaggagatcgagaccatcctgactcacacggggaaaccctgtctttatgaaaaataccaaaaaatcttagcccggcatggtggcaggcgcctgtagtcccagctactggggaggctgaggcaggagaatggcgtgaacccaggaggcggagcttgcagtgagccaagatcgcgccactgcactccagcctgggagacagagcaagagtccgtctcaaaataaataaataaataaataaataaataaataaataaataaataagactggctatcccagagcctggggacaggagagtgtgcgctgcaaagccagccatttgaggagggcctagtctgaactgaataggtcaatgggctggagctgactttggacagagttgaacaaccccaaagaatccagtgggtgctgggcatacagtcgtcaggcctgtgtagacagacctgggccgagaagaagctgggctgcagtagccagggcaaggcagaggggcaggaacaggcatgggcgatggggttgggccccagttctttgacctggggaatcccccaacctatgcttccatatgaatgaatcactgtgcatctgtgggcaccactgcatcagcttgcccctccacacagctgcccttggctcatgttggctgtgctgtatcagtccttcaacgtttcctggggatcagttaattaagttgaggtctctgcgtctggaaatccgcctcagcctgcagggaaaaggcccctagtcttgtttctgccttcagaaccctgagacagaacaaggagaatcctgctgattctcagattgggctccagaggggcgacagtgtcaatcacaatgttagatactgaagttggctcagttctttttttttttttccttccccttctcccctcccgtcccctcctttcctctcccttcccttcccctcccctccccttcctcccttttctttctctttctcttttttttttggcggagtctcactctgccatctcactctgcagtggcgcaacctcggctcactgcaacctctgcctcctgggttcaagcgattctcctgcgtcagcctcctgagtagctgggattacaggtgtgtgccaccacacccagctaatttttgtatttttagtagagatggggtttcatcttgttggccaggctggtcttgaacccctgacctcaagtaatcctcctaccttggtctcccaaaatactgggattacaggtgtgagccactgcacccggccttttttttttttttcttcttttgagacagggtctcactttgtcgcccaggctggatgtagtggcagaatcatggctcactgcagccttgactgcccaggcccaagccatcctcccacctcagcctcccaagtggctgggactacaggcttgcaccaccacaccaaggtgaagtgttgttttgtttgttttttgtagagacagttttgccatgttgcccaggcagtgatcctcctgcttcagcccccacaaagtgttgggatcacaggcgtgagccgctacgcccggccactttcttacctaaaatacctgcacaccctacttggagaccctagggtgaggggagtggggaacaggagaacctgacagtagagggtacatgtaaggaggagagggacaagcttgctgtgtggtggggtgctccagggctgggggtgcctagggatccacctctctcccaggctgtggaattatcctccccgcactcactgcttctctaaccttggctatctcctgctgcctttggggtgtctgatgggcttgagggacctcccagctgctctaggtcatctcaccgcagccatgtgccccatttggtactgtcaaagctgctggaatattatcgtctttccagaactatccctggggcaatatcaggacctcaggctgcccggggctcagagccctcctgggtcttcctggggcccctggtccacatgcatctccactaagcctgagggcccttcgggagaggcagcacttttagcctgcccttggttttagcttttgctctacgaagatcttgtgatttctgccccaccatggggcagcaggaacctcaagcacagtgcctgcggcaaagggagccacaatggacttgccccaggtcaggcctgcacttgccttgtgtcagggtatctccccaagttgctggcctcagtccctacactgacctgtttccccagctttatctctggcaccccaaactcagcagccccgaccccacttcccaagcaccccctgtgcctggctctgtgcctgtcatggtgtcctggcagcagtctgggagagtatttcagttacctgcggtgtcctgggaaggctggagcagaggggtccactcactgattgccaaggtcacagaacaggacttgcattgtgcactggaggccctgtggtcttgcatgagcctggtaggcctctcccctcctgcttccagccctccatctgggaggccagcctgcccagggctgctctgccacttagcagctgtgtggccctggagagtccctaacctcactgaacctcagtttctccgtttgtgaaatggagataatacaaagagaactttccttctcaggctgttgtgatgggtaaggaaataaatgcatgcaaaatcacagctgtagttactatgaggcacactgtcttcctggctagaggagattctgaaggtgggtggggcagcaagatcaccacgtgtatgaaatgggggcaggctggttggagactgagggcaccagccccaagcactgccatctgccctgtgatgggactctcctgtggcagtggcaacggtcccactgtggaagcaacacatgagctgagaggacttgcctgaactgagccacatgtgccctctgggcctggtcaccccaccacctgcccccagtgtgacccatgcagggcctgttcctgaccctgaacgagaccaggactccctgggctgcatttcctatctgtaaaattgtaggagggtggtggtggtgggggctcgaacttgccccctgggtggggtggggcataaatagtcccagaggatggcctgggaaggctggctgggcctggcacaggggactttactgctgtcattattgtcctccttacaggagaggagagcaaggcccagaccggggaggaacccacacagcctctgtgctccagcctgcttgaaagacaaggtctacctacaacgcagagatgcacacattaaggacaatgaaacacccaagtgttaggaaccagaataatcagccctaatagaggggaggctgatcagggagggcctcctggaggaggaggcacaacatcagggtgcactgtgatttctggagacccaaggagttctggtaaatgacaggtgagaaaaagaaaatgtaataaaatataattgaaaacagaccctggtatgtgtggagagagggccgggaggaacctaggacaccggggaacctgaactcccccaaccagtgaagggagctgtgggcagcaaggtttgattggggttttctttcttgtggaggtttctcagagtgattcaagttcccccaccccgcccacagatggttctgagactttggaaagaaagaaaaggaaaaaagaccctgcccgcgccccagctgggcatccctgggaggtcgcgaggatccccggagacccagactcgggcccggggcgcccccggccagagcggcccctggctgcctccctacgccccgcgactccggtccggacgccgagggcctcggcctgcccctgtcccccggccgccccccacctgctccggcccggcggggcggtgctgggcccgcgggctccccggccgcagtgcaaacgcagcgccagacacgccccgcccgcgcctccccgcccccccgcgcccgcggccccaagcggttcccgagcccaggcccgcgccgagcccaggtgagcgcccgccccggggaccctggtccccggaaccccggtccccgcccgccgccccgcctcttcgccccggcgccgggggccagcgcttgcgctcccaagtctcggaccccggcccggcacgttaggggctgggggttggcaagcggggccagaggcactggccggggtccgaagctcacctcgtccttctctcgtcccacaacggccccttcccggctcgccgcggggccccactgtgtgccagtcccccttctcgggctgcaaggtctggcgggggcaacgggacggagccggcgaggctgctggcatcggcttcccagagagagggaactgcacgtgcagaggcggggagagtggacagaggcttgccctgagctccgtgggggaggggagagcgcggagcccccacactcgaaggcaggactgggatcagatgccacccctaggacgcctggaagccactgggagtccgatctgggcaggagcccttgggatgaggcagtgggggcaggtggcgagaggtggaggagtggggagaggaccctgcccagcctgcaccctgggggcgccaggagccctgggagggtcaggtggagcaggggccgctctgtgagatgggagtaatccagtcccgcctcacaggtcctggggtccctgggacagacacagactcctgctgggtggttagcactgggctctgctagaacttttctgcagtgggcagctcatgggcaaggaatagcactcgggcgctctgcactctgggggtccctcctgccctgcccctggcaaggacctttgcctttgagtggggtgactgggctccaagccgatctagcacacagtaggccgaaggcacaggggccccacccagtctccttcctggcccaggccctgggggattcaggtccctgggtactcgggaagggacagcacagcctgggcaggtccccagtggcaagaccaggtctgaccttttctgggatctgtggcccatcaggtgaggcctgaggtcagccaggaaggaagcgggcagggctgaaccagggctgaaaccaggacccaggaagggacagcctagtgcccagggaaggggcaggtggggcaggtggcagttgagttttacagaccttctttgatgacaagtgggggaaagagccaaggcacgccccagtggctgtgggagccaccgcctcctcccctgtaatgggcacctcgaggaccgacaggcgcaggggccaggcaccaagggtccctctccaacctggccttttgtttccaccccttgctctcaggcacccacccacggcccttcctggtatctggaccagaccaggtgggtctcagccccacctcaagtgagacttcaggaagaacttccagaggaaactggaggatggcagtgggatggactgtggggaggtcatttgcaaacaaggcagcttatgcctgtgccctgggccttccaaagtccacctgtaggctgcatcttccggaaggcccaccctgtagcctggaaggcacctggctacagtgatctctctgctgtgcaggtgtcccctcccccagggcaccttgcagggccttagggtgatatgggggctttctgggcccctgcccaccttaaaactgatcaaggtgggagggtggggtgggaggccacagggatgcccctgctgcttgaccttgatgggaccttgaccccttgctttccccatatgctgttgggcatgactgcccacaggcctggtgggcgtttgtgaagggctggagtcgggggtagggggagcttatggctgctgggcacaggcgtggcagggctgtgtgcctggcttccctttcccctaaccccatcaggcccgggctggccgcccacttctgttcaccacagagcagggtttccctggggaccagtggactggcccagccccacaccgccccccagcccctcctggccacagcttgagctgggaggagggtggaggctgggccgcctcctggacccctgccctccctgcccggccttccaaggcccggcagcctcagtccactgctgggcctggaacacggagcagtggctgccctgcgaggaggtgggtgtccggagtgctagccagggtggggctgggctagggggagcctgatgtcacccccattgtaggagggagaagaccaaggatgagaagggctttggcttccccaaggtgaccccctctttgagcctaggcatagtggtctcccgggagaatggagggtcccagagctctcaggctgtgggatttggagaggggaaggggggcacgaggaggcagtagaaatcagggaggatttcctgggcaaggcagccgcggggctggacgatgggcggccgaggttcgggcagaggaactccactggaggagtgagggagctgagcttggagggcttcaaaggggaggtgacctccagggccccacgctctgggatcaggctcacgccatggttcccagctcaaatgtaagactctttccgaagctcccactgtctctctccgtccctctgtgtctctacctgcccacacgccccggtcctgatggctccagtctcccctgcaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccaggtacctcctgtcttcttgtctccatcctttctcctccctccccgcctcctcctcccccgtctcccccccctccccctctgcactcggtaggcctccgaagtaggtcaggctatccaagaacccgctcggaatgttaatacgctgccgccaggagggggtagggggcctggagcagttcccccagctggcccctgctccagtgggtgcccctttttctttggggctttgagtgttggtggtgggaataacagcaggacccttcttggaaaaggaaagtcagggttcctcctgttgcagggttggggaaggggctatgcccccagggccagggaaggggggagctggggacacgctcagccactctgtgacctagggcatgcaagttacccctctgagcctctgtttttctctctgcaaaagagagggcctggccaccctgacctcttagagttgctgtgagggtgtagtgggcagatcctggctctctttgcctcctctgatcccctgtgtggtctcgggctgccttcttggcctttctgggcacacttccccatttatacaggaaatcaccatccaacctagcctgagctactccagccagaagtgggagtgtcctggggtgctaggggaggcctgggtcttttctccactaaagactcatgtctgcggagctctccctctggccccccactttccctcttctctcctcacaacacctggggaggcaggagtgtgcagctttgtcacaggtggagaaactgaggcttagagagacctcaagagcgcagccagtgctccactcaacctgccaggccacgctgccccagccagctcaccccagccagctcaccccagccagctcaccccagctccccttacctgatacccatcagctccgttaccttggaacttgtgaggcttttctccctttcctgggtctaagggagaacttgggcgagggaggagggctgtgatgacccaccaggcagagggacccacttgcctctgctccaagaagccactcttcctcccccgctcctgtgctgtggacacctaggcctgggctggatccctctctgcctcaaaatgtgccttgggcagatgacgtccattgtctccccctagcagtgggtgggatgatgccagctggcctcataccaggcgtctgtggcaccgctgggctggcaggaggccctggcagaagatgccacctgcaggttcttttaaaggaccccaaatggctggcctgcctgggacccgtggccccaggacttccagtgtcgggggtggccaccctcaccaaaggcagtcctaagaacttaggcaaatccagccctgcccctttctggctgtgtggccttgggcaggtgatttcccctctctgagcctctgcatcctcattgtaaagtggggctgttgtgcctagcatgagggcctggcacaccagaagcacttgcggaattttttttttttgagacagagttcactccttctcccatgctggagtgcagtggcgtgatctcggctcactgcaagctccgcctcccaggttcatgccattctcctgcctcagcctcccaagtagctggaactacaggcgcccgccaccacgcccagctatttttttgtatttttagtagagacggggtttcaccgtgttagccaggatggtctctatctcctgaccttgtgatccgcccatctcggcctcccaaggaatattatttgttatcccttttctgagctgggctctgtgctgccaggcctcccctgtggggctgtagccagaggctcaggccccaggtgcccatgctgggcaggtcaggcatgaggctcagggaatttccagatatgggagtgacagcatttggggcctgagggttcagctggggtcttaaggggccacaaagagactagatcaagcagaagacctctgtgcaaatccttcactttctatcttgctccactcgattctgtggctccgtgtgcatcagcacctgcttcctgggttcccctctgtgctcctgtgtgtcctgtctgagtagttgataagaaggtatcagaccagtccctcacctagctcagagctaggaggaagtgcagctctcttagcatctgttcacctgccttttattaggccataactgatacctaaaggctttccatcctcaccatggctgctaggaggctcagagctaactggtaaaacactgctgcccaactccatctattgagcttctactctgggttacatacagtatttccttcagcattcactgtcaccaacgaggtaggcatttgctgttctctctgttttattttcattttttgagatggggtctcattctgttgcccaggttggagtaaagtcgcataatcatagctcgcagcaacctagaactcctgggctcaagtgatcctcccacctcctgagtagcagggactacaggcctgcaccaccacgactggcaattttatttatttttttaacttttttattttttgagagacaatctcactccctcacccaggctggagtgcaatggcttgatcttggctcactgcaacctccgcctcccaggttcaagcgattctcctgcctcaggctcccaagtagctgggattataagcgcatgccatcatgcctggctaatttttatatttttagtagagactgggttttgccatgttggccaggctggtctcgaactcctgacctcaagtgatctgcctgcctcggcctctcaaagtgctgggattacaggcatgagccatcattcccggccaactggcaatttttaaattttttgtagagactgcatctcaccctgttgcccaggctggtcttgaactcctggactcaagcgatcctcctgccttggcctcccaaagtgttgggattacaggcatgagccaccacacctggccttctctccattttataataaaggcatcttaaggcccaaaggggctaaggcaggtcttatgggcagccagaagtcatggagctggggctgatccagttttgtgggtgagcagagacgcctctcccctctacctttccaaagggcccctgacttaatggcttccattagactgcatcagtgagtgggcttggagccttctgggaggaggtggaggatgagagcagcctggcttggcattatctggcccccctgccaggctatttgtgagctcccacagcttccacagctggtgtcagctaagtccaaagtatttctctttttaattcttccaaaaacattctaacaccattacataaggtatagaaaatggaatgaaagccccacccataaccccccacctgatacgatggcctcagtgtggctctgtgctctgcatcctccctgctgggctggggtcaaggaactgaccttttctttgcccctgtgccctgctatgcctgggcctgagctgagggctgggacttggggctggggaggggacctggccagcgtggaggatttagcagagcatgagatgatggatgggctgggcagccaggagaggcaactcctgagccttgtctgggtagataggaaggatggcagccccagcccaggggacagctcaggcaaaggcctggaggtgcatctcggcagcctctctgggttcttggtttctggagtgtcagttctgaggtggaagggatgagaggtaaaacccagaggtgctggtgccttgggaagtgagagaggtacctcctgctccagcatcgggcccatgctgtgccaggggcttagtgtccatcactcagcttcctccctgcagcagcagcctgggaggccagattattgctgctaaaaattctgtttattgttcccttctaattagaaaaatatcccaggcacatcacagggaatttggaaaatgtgcaaaagtataaagaagaaaatggcaatctctggctcactccccgctagagctggccccgtgggcacgctggggaagtggctctgtatggaggctgtggggggggggggctgtgccccctctgtgccatccacatgcattcccatgctcaggttcacccccagggcacacgaggacactgaaaacccagcacctggttagtgatgaaggattctcaaattggtgagaagagctattttgagaagttgaaatcgggccgggagtggtggcccacgcctgtaatcccagcattttgggaggccgaagcgggtggatcacctgaggtcaggagttcgagaccagcctgaccaacatggagccctgtctctactaaaaatacaaaaattagtcaggtgtggtggcacacgcctgtaatcccagctgctcaagaggttgaggcaggagaatcgcttgaacctgggagggggaagttgcagtgagccaagatcgcaccattgcactccagcctgggcaacaacagcgaaactccatctcaaaaaaaaaaaaaaaagaagaagttgaaattatgctgtgaattatgctgtgtacattttttttaatttttgaaaaaaattcaaatatatgggaaagttgtaagactagaacaatgaacccttgacttcctgtcacccagattcactggctgggaactgagctgctgccacttttgaattcctgtatgtacatgagtcataccctgagatgtcagggacattgtcattgtccatcagaagatgcaggactgtagggcctcagggttctttctgccacagaggtttctgcagccaggagaactgcagggtcgaaggaactcagctctgtgtccccctcactaacactgtaattgaaaaaggaggcggggtgtggtagctcaagcctgtaatcccagcactttgggaggctgaggcgggcagatcacttgaggtcaggagtttgagaccagcctggccaacatggcaaaaccctgtctctaccaaccctgtcacgccacacctctggcgtggtggtatgcacatgaagtcccagctactggggaggctgagatgggagaatcacttgaacccaggaggcagagactgcagcgagccgagattgcatgactgcactacagcttgggcgacagagtgagaccctgtctcaaaaaaaaaaagaaaaaagagacatgcagaaacgaattcaagcagacccgggagcacccccacccatccatgcccctccgctgcttcgtgccaggtttaaggctctttgctgggctggtggtgcagagggaattctggggaggttgccaggcagggctgagcctcctggcaccccgaggagctggcctctgcacccagcttgagggatgggggaggaagttggctgaggtggggggctcaaggcgctgccttgcccacagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagtgggttctgggcttgcctgggagcggggatcaggggtcccaaggtgggagggtgagggggccatagccgggggtcggggttggcctgaaggggctatgaccagctgctgccctggtcactgcctttgtggcttctaccggtctgggcctgctccccagaaggctggacactgggaggagctgccaggaggttgtgcctggtgtctggcctgacctctgagtgctgcggttccccaggatgcgggaagtggagctgggctgggggaaggtgttgctggtgaaggacaatggggagttccacgccctgggccataagtgtccgcactacggcgcacccctggtgaaaggtgagctgtcaggtgggaggcgtgagggggaccttccaggccccatgccagcttggctcctccccagaccccaggatcttcatctattagtgaagtctcctgggctgtggggaggggcccgcagttgccggggcactgagatccttgggaagcaacccctgctggtgggcgcagcctaacacctccccttcccaggcgttctgtcccgtggtcgggtgcgctgcccctggcacggcgcctgcttcaacatcagcactggggacctggaggacttccctggcctggacagtctacacaagttccaggtggggccaggagtgcgatggggtgggaacctgggggtgtggggttcggggctggtcctgagcaatgcagcccttgcaggtgaagattgagaaggagaaggtgtacgtccgggccagcaagcaggtgaggggatagctcggggctcaggcagaagggaggagccgggagggcatcttggcccagagaatgccatgtgcaaagccctgtggtgggaggagcttggcacgtgtcactggagcagagtgaggggttgcggtagggatgaggctgggctggagcgccaggacctgcctgccaggatgatggcatgcagaggatggcagtgaccctccaccctcctggcacccacaggccctacagctgcagcgaaggaccaaggtgatggccaagtgtatctctccaagtgctgggtacagcagtagcaccaatgtgctcattgtgggtgcaggttggtagtggggtcatgaggggcagggtgggagatgggattggtgagaagtggttcctggcccacgggcccctcccctcaggtgcagctggcctggtgtgtgcagagacactgcggcaggagggcttctccgaccggatcgtcctgtgcacgctagaccggcaccttccctacgaccgtcccaagctcagcaaggtacagggggtggggcaagtagggaccctatccctctgggtcccagttaagcccacttcaagccttgcttgtcaccccattggggtctggccggctgccctccctgcttatgccaggcctgtccgtggtacccccaaaagatctagatttgttgttgttgttttgagacagggtctcactctgtcgcccaggctgggatgcagtggcgccttctcggctcactgcaacttccacctcctgggttcaagcgattctcatgcttcagccttccgagtagctgggattacaggtgtgcaccaccaccatgcctggctaattttttgtatttttagtagagatggggtttcaccatgttgcccagaccagtcttgaactcctgagctcagcccatccgcccacctcagcctcccaaggtgctaggattacaggtgtgagccactgcacctggcttttctttttttgagacagagtcttgctctgtcactcaggctggagagcagtgcctgtctcacggctcactgcagcgtcgacctccacctcccgggctcaaacgatcctcccacctctgcctcccgggtagctaggactacaggcgcgcaccaccatgcctggctaatattttgtattttttgtagaaatgaggtcatttttgtcatgctgcccaggctggtcttgaactcctggttcaagcgatcctcctgtctcagcctcccaaagtgttgggatcacaggcatgagtcactgcgcctggccagatctgggtttgctgagttctgtcctgcagcccctatgtgactggggctggccccaccttccctgggccccagtgtcttctgctgtaaactggctcctctcaagctggctctcccctgcagtccctggacacacagcctgagcagctggccctgaggcccaaggagtttttccgagcctatggcatcgaggtgctcaccgaggctcaggtacagggtcaagggtgggaaacaggcccgaggagggaaggtgggaaccgtgaggttgtgtgggcccctggggtggggtcttggtgctctaccttcctggccccacagcccaggcacctgggaggtgctccaggcttgggagacagcaaggagctttttcctgatgggtcataggcacacacagagccccacggtgtgtggagatgaacgatcagggctggataggagatactggtgggacttgggagggtaaggagaggtttgaggggaaggtgatgtctgaagcgtaaagaatgaagcccaggtggcaggatctgttttaatgggagcttctcagaggctgtggctgggctgtgggtgtactgcaggaccggggagtgggcggcgaggcccagccccatgcccaagctcatgctctgcctggtggggattgcaggtggtcacagtggacgtgagaactaagaaggtcgtgttcaaggatggcttcaagctggagtacagcaagctgctgctggcaccagggagcaggtgggagggtctcctttttacccatcggacactaggcagggcactggcctggacggggctggggctgccaggaggccctcactgacacggccatgtctcagccccaagactctgagctgcaaaggcaaagaagtggagaacgtgttcactatccggacgccagaggatgccaatcgcgtggtgaggctggcccgaggccgcaacgtggtcgtcgtgggagccggcttcctgggtgagaggtagtgggcagtggagatggtggtcaggtcgtcatggccagtcccagggaagttctggtcgaggaaggtgcaggtgccagcctgccaccccctgcccatcaccagggatggaggtggccgcttacctgacggagaaggcccactctgtgtctgtggtggagctggaggagacgcccttcaggaggttcctgggggagcgcgtgggtcgagccctcatgaaggtgagcccaccccagcacccagtgccttggagccctggggcccagcccggcccctggctgggctctcatccaccgcccacctgcccacttgccctgacagatgtttgagaacaaccgggtgaagttctacatgcagacggaggtgtctgagctgcggggccaggagggaaaggtgggcccttctcccttctccctgctgctttctgtcctctgtcccctgagcctgggagctgggtccacctgtttatccacccactccccacagctgaaggaggttgtgctgaagagcagcaaggtcgtgcgggctgacgtctgcgtggtgggcattggtgagttggtgtgtgggcaggcaggcacaaagcagcccagccgtctgcacatgctcacatgtgaccttgggctagtcccttcccctcccagagcctcagtttccaccacatctgtcaaatgggaacccccaaccgcccccactttacggagctgttggggaaggtatgtactgggctcagcccaggcctggcacagtggatgctcccagtgcccgctgcccagtaacactcatctccatgccctgcgagagttgacatagacgagactcgaactggcttctgctccagctgaagtgccaatttgggtaggggccaagatgggaggtggtagcacctgcaggggctgaggaggtatggcatgctgtccctccacttaagggcctcatggagcacttcttggagaaggtgatatctgaggtcttgcgggaggcaccgggtctgtgggagaccgggtagtggggaccagggtgcatgaaggcctcaggtagacagcccctggaggatcagtctggggctggcacatcaagcgcatgctgtagggtgtggagagtgactacgcagaaggcagggacaggggagtggacacaggcttccgtcctgtcaggtgcagtgcccgccacaggcttcctgaggcaaagcggcatcggtttggattcccgaggcttcatccctgtcaacaaggtggggtggatggcactgggtggggaggacccggtgctgggctgggagtggcaggaggttcaggtcagggcccctgtcacacccatggagctctgggccctctctctacagatgatgcagaccaatgtcccaggcgtgtttgcagctggcgatgctgtcaccttcccccttgcctggaggaacaaccgcaaagtgaacattccacattggcagatggctcatgctcagggtatggccagtcccgaggcacatggaggggtgggagggagtctcagggtctcagtgtccccatgcccatgcctcagttgctgaccttgggtcctggacactgttaggcatcaaagctctgatgtggattctctggccagcctcatctcggcgatccagccaacacagagagcgacaccccactgagccagccatagctcctcaatctcagttttccttctggtagtctctcccttttttgtcttcaaggacatatattctgcagaattcctgatcaacctgtgcattaccctggggagggagggagggatttagtggatcaccttcccatttatgcctctgtttcccttgggccactcaagtatctctgtgaactcagttcagcctcatgcaggtccccgaggtgccatctgagcccagagacgtgggctcagtggaggcactgtgctttctgaggaatagctttcccctcctgatgtttgctggccaccaagtcccccaagcctcatccactgtgcacatctggtctgggcccctaagctgcaggtgccatcacattagttgcctcactgcctcagagagaggactgccagactcccagcctgggacaaaggacttctctgcacccatctcccctttcctctgcctttacacctgagggtctgctgcttgaaaccccacttctggtaccaatttctattcaagtccaaagtcgaaagttgttgctaggttgtaagtaaccaaggcaacttatcagccaagtataattaggatttaactgagagagtttaggggactttgaagtacatccaactacaggggtctactggggcctcataggaactggggagccatccacactggtctctttggggccttgtgtgtggctgtcatctgtgcttccctgtgtacttgtgccccattttcctccctcttcagacctgatacgtctgattaggtgtctgtgtgcacagctgaaatggtggcgtactcccccaaccccaagaagcagaccttccagagtcagggcactttattcagattctttaaggaagcaatcaagtggctagctttgaggcaggtgttcccctgcaccagtcagctgcaggtgcaagtgagcagtgggctgaacaatgatgtctcttgacctctggggagaccaggaggagtagccacacgtgtcaggggtccccagggcatcaggagcaggtagtgtgggagtggtaagagcgagagttagggttctcacggccctgggtcccgcagggcgcgtggcagcccagaacatgttggcgcaggaggcggagatgagcactgtgccctacctctggaccgccatgtttggcaagagcctgcgctacgcgggtaaccccggggcctcggatgggggcggggccgagggcgtttaggggcggggcttgggtgtggggcggggctgggagcctaggggcagggctatgaccgcactaggaagaggccggtaagaactcgctggcggcaaggctacgaactacctaaaaggacgtatggagcagggcctgggcggggttaggaggggatcctgtgacgtctcgttccctcccccggctcacgtgggtgccacccacctgcccggcccacaggctacggagaaggcttcgacgacgtcatcatccagggggatctggaggagctgaagtttgtggctttttacactaagtgagagcaccggggtgcagcttggcgcgaagcagcgggagctcagtcgggaagggggattcatcccaggcaaaatcccagaacaagagcccagccctgagccccgctgaggagtgctggagcttccttaggaaagcccgaagcttgtgcacggtcaagccgcgatgtgcaaagcagggagggctgggtgctcaggccattcttgttgccctggggtaggtccttccctgggccccagatggacagcagtgcatcagggttttcaaaaaggggctgctgcctcgcagtcctcaggcttggccatcctctccttgcagaggcgacgaggtgatcgccgtggccagcatgaactacgatcccattgtgtccaaggtcgctgaggtgctggcctcaggccgtgccatccggaagcgggaggtggagtgagtgtgggtgtgggaagcctgggggtgggagtagttccctggagtactggctaaggtgcctatgacagccagccgcccccacaaccctccagggcctttcccctcttggtttgcatcgcctgaggcttacaggactacagggaggtgtggggcaaggatcatggtttgagagcaggctggttatgtgttcatggtggatggaagggatagagatgtgtgtcaccaggcagggccagtgctgtgggaaggggtcagggcccaatgcatgggcaatcaccaggcgtgggacacctaactggacatagttgtgctgagcctggcagaagctaggtgggaaatgcagctactgatgccctgggtatgccctccacatagatggtgggggtggttctaggtttcactcaacaccagccagttcccttatcctggtgtggtgtcaatgagattcaccctctgggagagagctcccagggactggggacagcctggaggccactgggaggctatgagacaggggcaggcttcaggctggaaacaatggaggaccagaaggggacatgataaatgacatgctctctccttggccttctctccgtttctctctcttgccttcgtgaaggctgtttgtgctgcacagcaagtacgtgtgtccttcatgttgaccgttctgagcctttcccatgtcagcccagaccctccacccaatggtcttatctccctctgtccaagtacacctccctgctgggcactagggtctggcacagaacagaccccctgctgtcctcaagggccagctgttcagggtgcccagagtggagagcctgttttcttctgtcttgacccctcctcccctcactcctgcaggactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatctgtatgactcccagtgtaattgggccaataggcacaggaccagaccacagggaaacaggcacaatcacagaatgccaggtgccacaccaaggaaatttggcctgtgaacgcccagaggaggtagcaactaattctgcgccccaagccctcccacatccctctccccctctgcgatcagcgaacgctttttgcttttggctctgagttttgaaggaagggtattccaggtagaagggacaacatgcccaaaggtcttgagatagtaaatgctccttcagaggtggctcatgcttgacactttggggcatttgcccacttagggctgtgggagctgtgtcctgagacagaccccatgcttttcatagccggagcattctcaatccccatgtcggaggtgaaggagctgaggccctgctaagtaggaatgagaatccagaggctcctcgccgggctgcctctcagtcagtaagaaagccaaggggagaggggagttgctgggggtcagggctgagggcgctagcaggaaagggagcgttgagccgcctgcagaggccgctgcgagcccggaaccctccatgggggatcccggcagcggcagacgatccaggccggagccacgcgcagacccagggcatgccgggaactgcgagccggccgcgggtcttcgggctgcgtgggcctgggaggcgccgggaagagcagtcgcgacggggctagggacgacacactgcattcactggaagggacaacgcagcgccagtacatagcctgaaacgctccccagaaggtcccacgctcgccgcgcggtcgacaaccgcatcctgcgctcgcccgcggtgtctcggcaagcggtaggcttgtcgggaagagctggagggcgcaagtgcggcgctggccggacgtgccgcaccgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggtacggtgggcttcatggggtcctgaggacaggaagggcgatctgcgagggtcccagggcgggtccaggggcgaagccggggggtggtgtcctggggtaggatctggtaatgaggtggatggtgctgtacaggacgctgttcagggcaggggagagggttccgagggagtcccagagcccgatgtcccgggacagggtactggaactaagttgtgtttgtggatattgggctggggtcccaggtgctctgaggtggggtgaggagtccagagagtcctggagccgtgtcaggggtcctcacttgcaggatgattggtgttatcttagaagatgatggatcttagcagttgagaggtgatacctaacttccgtggcagctctcctgcttagtcccattccttgggtgccccccaggagggtcctgtccttaccgccctccactcctttctttccaggcgcagcaagcacacagtggtggcctataaagatgccatttatgtatttggtggagacaatgggtgagtgagtctcagcatcagtgtttggaccaggtacggagaagtactgtggtcagggactgggcctgtccagctccattactgtcctttcagatgctagctggtgcctctaagcttcagtttccccatctgtgagattccttgcactcacctccctggtcgtggtgaggattaaatgagatcctgcactcatggtcctcagcacagcttccagtgggtggcacatgctcagtatgtggaaatgtccctcttctgagtagatgcagccttgaaagaaacacaaccacccttgcggccagccctgccaggcacttttctttccctgtgcctcatcggtatggaggacacagttttatttatttcatgcatttttcactttttgtgggggttttcccaaattgctccaaacatcaggcaacaacgtgatgttttgttggtgggcacacctcctttcacataaactgtctccacttaagttgtggctggtttccttatgcagagggtggagtatttgcacatgactagttgtgtccatgtgtcctagccctgcctctcagccccaggaactagcatgaagccctggaaggtctggcctcttactggctctgcagccttggtcctgtaggcctccttggggggcgggcttgaggatggtggggtagtctggaccccaccaggatctgcatactgggcagaagagcctccttgggcatggtcccctggcttcaagcctgtcttcctcccactctctttccccaggagtagccggtggggcccatttacaaaagcaagtcagagtatgctcctccttggctcatcctcctgtaatgcctccctgcctctctgagtaaaagcccaagtcctcatgagagtctgctgctcctctgccctcagtccctcactgcactggggcggcacgggctgccttgctatgtttggattgtaccaagtgcccccctgctcaggcccttgcactgcccattctctcctctcaccttcctgcccctcctctgatgtttcttgtgactgaggccttacttggccatctggaccaactggagaccattgcttcccctccatacctcttaccatcttcatttgttcctgaggcacacagatgttggttattatccatctcttcagtcaaggcagggcctgtgctccttttaccattgtatcctggcatctagaaaactccataaatgtttgtcaaatgaaggaatgaaatgaagaagagatgcctacccacaagcatttactgcagccttaatgagaaccctccaaaccagaaagggctttagtgtccagtacaaggcagcaagtgggaaatgggggaccttcatcctcaagagtgtccttagcaggtagtttgtgtgacaactgtgtagcaataagcagaaacatttttgctgcagtatgacaaagaaataggatacaaatttgtctcacactagtcttaactttataaagactgcctgagtacaaagaaagatggcctcctgcggcacgtggggcaagtaaggagggggggggggcggtatcacaatcaccaccagcttctaggctcctggcttcctggctgcatggcctcagacacagcctttgagccactaggctttgttgccatctgtgaaatggaggtgagagagcacccactggtgcagactaagtgagaccgttcagggggcacccagcacaggctgggcatgacggggcactgggctcctgtcagtttgcccttcttcccaagggctgggtagtgatatgccagctggtagtgttaggtggtgcaatggccagtgaatttgttttctatttgattgtatggcttttgcaacaaagaaatggcaggggccaggtgcagtggctcacacctgtaatcccagcactttgggaggctgaggtgggaagatcacttgaggccaggcattcaagacgagcctgggcaggaaagcaagacttcgtttctatttttttttttttttttttgagatggagtcttgctctgtcacccaggctggtgttcagtggcgccatcttggctcactgcaacctctgcctcccgggttcaagcgattctgccgcagcctcccgagtagctgggattacaggcgcctgccaccatgccaggctaatttttttgtatttttagtagagatggggtttcaccatgttggccaggctggtctcaatctcctgacctcaagtgatccgcccgcctaggcttcccaaagtgctgggattacaggcgtgagccaccgagcccagcccattgtctctatttcttttttttaagaagtggcaggaagatcagagagaagcaaagggcctctcctgaggcacgggcaagcacttgcattgcagggtacagctgcagaggaaggggattgggacgtgtgaataggggttctggaggctagggtgaggtgtgagggtgactctggcctttgggccatttcatgccttcatgtcagctgctggttgggctcctggtggccacattcatgctttggtcctgaccccaggcaggctggtgtctgcctgtgtggcagccctggtgcccatatcagttggggagcctcctttgtggtcaccactcttgttcttgggcatcagctggttgcctggctgtgttagtgacccagcccacaacagccccctactctaccctggctacatgcagtgcccatctctggggtcactgcagagtagacctggctaatgccaccctctcttccggctgcctttcaggaagaccatgctcaatgacctcctgcggttcgatgtgaaagactgctcctggtgcaggtgggtggccccgtgctccagggccctgcctttcctcctagaacacagtggcacagtgctgggtcccagttgctagcagagtctctctcatcatgggaagctagaaagaagcttccaggaggagataaccacggcctcagggatgccacatccagagccgccctgtcaggctgaggagatcaagtaaccaccccgcacctgcagctgccaagctgggcacacagggcggcacccttctgggctgtccacctctacctcgaggctgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagatagatagatagatagatagatagatagatagatagaaagaaagatagatagatgatagaaagacaaagagagatgatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgatggttagatagataggtattaaatgaaattgatggaccccgtgctgtaagatgctgcactgctgctgagagcaggagtgtggatggtcctggagtagcatgaggacctggtcacattctgtgagtggaataagcaatttacaaaatatctgccacttgattccattttaaaaaatttcatggaagcctaagtatgcgtaggagaggtgtgcagggaagacctcaaggtgttgccagaggttttctggtaatgggaatttgcatgagctttagtgcctattttgttttttccttattggtgattttttttttttaagtttctatgatgagacaggtatcaccttcaaaatacaaaagtgaaacgtagctgggcgcggtggctcacgcctgtaatcccagcactttgggaggctgaggtgggcggatcacctgaggtcagaacttcaagaccagcctggccaacatggtgaaaccccgtctctacaaaaatacaaaaaattagctgggcatgatggtgggtgcctgtaatcccagctactcaggaggctgaggcaggacaatcgcttgaacccaggaggtggaggttgagccgggatcgtgccactgcactccagccgggacgacagagagagactccgtctcaaaaaaaaaaaaaaagaaaaaagaaaggcagcacagggatgcagggccaccctgtgggggtgtggacctcatgggtgacccccgctgactctcaccacccctgtgcccaccccagggcctttaccactgggaccccaccggccccccgttaccaccactcggccgtcgtctatgggagcagcatgtttgtctttggtaagcagcctcttgcctcccaggggctgtgtcgccccgaggcccacagacaccctgcccttctgcaggcctggggcatttgtgctcgtgctgtgtacagcaggggctctctctccacccgtggctttgtctgccagtcttcggaattctgcgctggatctgggaccccttgccctaacggccctgagctcacagggttgggtgtctttctgtgttactgagctgtggctgggaacagtgtcctgctcatctctgtgtccccagagcccagcacagaggcagacaggcagcaggtcgttccggggcttgtggaaggagtcctggcttatgcattttcaggggggccagattctgctccaccttccagggtttgaaatctccaagactgccctttgggtttgacagtttctcactctctttactcagggggttacactggggacatttattccaattctaacttgaagaataaaaacgacctctttgaatacaagtttgcaactggccagtggacggagtggaaaattgaaggacggtgagaaactttgcagaaacatttgggacaggctgggtcctgggtggcattggacctgggatctgcccccttttgcctcccagatgaggaccctgagggcacgcaatagcagggagcttgggattggtggaatatcccccggtgcagctatgcatggcctgctcccagcccttagactccctcctttcagaagagacccaaatggaccaggcgtggtggcgcatgcctgtagtcctagtactttgggaagccgaggtgggaagatcacttgagcccatgacttcaaggctgcagtgaaccatgtgtgccccactgcactccagcctgggagacagaacaagaccttgtcacaaaaaaatgttcaataagatccaatgtactgctgatggcgcttctggggtcccgctttttgagcaccccctttgatattttgggggcacctaggagaaggttctgtgcctctgtggctgtctgaattcctcttcaagccactagtcggcctctggggctgttgtttattcctagtgccttgtggaggtcctgaagccccagtgtcgggtggatgtagccatgcagcctggctgtggcccctgcactgaccacatggggctgggtggctcaggtctgtgctgggcggcctcactccctcccctcttccctcacactccaggttgccagtcgctaggtcagcccatggggccacggtgtacagtgacaagctgtggatctttgctggctatgacggcaacgccaggtgggtggtggtccggcctgtgcaccccacctccgacagcactgagacccggagcaggccgtcctggcatttgagggcttaggctgggaggattttgagtgcctggtggattttgagtgccactctgtctgggggtttcttgggagggggatggggaaagaggaggatggacagatggaggtgagggccactgggtggagccccgtggctaccagagtagcttggatgaggatcctcagccaggagttgccctgcggagctgagttggtgggcgggtgggcggtgcccaggctcaggcccagccctggttcttgcccaggccaaaggccttttcctccttattttagaaagttggctttgctctctttttctgatcacaaaagtagcatatgctggtttcccaaaacttcagcatcatagaaactcctaacgatgcagtgatggtggcatctgggatatctgtgtcctctccccacccaggagggacactgagtgaggagctggcactgccacactgccctgatgtcatgcatgagagtacttgttctgtctgggccgggcagggggcctggcacagcagggatttgaggcagtggctgccaccccacacagaagttcccgcctcatggccgcacaagtctcctaccctgtgtgggggtggggctcctccctgcagccatcccttccagccaggactaggcccaccctgaccaccagacccaaggggtcctcactggtctgtcctaatacaggttgaatgacatgtggacaattggcctccaggaccgagagctcacctgctgggaggaggtgaggggcgtggggagccagggcgcaggtagaggaggtgaggggcacggggagccagggcgcaggtggaggaggtgaggggcatggggagacagggtgcaggtggagggaggtgggaggcagggggagccaggctgggggtcgaggctgctttcttccccttgcaaagcccagcctcgacctgagcctcgctctcctccctggtgacctgcgggccttcacgaccagttcctcactgtggctgcacagtgattcgaggtttggtgctttggatgggcagagtgccacgtgtgtgaggatgtggttttgctttaacgcaccctttatttcagtgcagtgagggccgtctgctatccagtgtcctgctccctggagctccccctgggcttgctttcccctttagaaacatggaatttatttatttattcattaaaaaaaattgtttttcagtcttctgggcatgaaaaacatgagtttagcccctgatgatttaaccctgacgattttaaccccagctgttcacaactgggccccgtgaagtggatgagacagggctatgagctgttccaagacaaaggaatctgtgaatcctcatctggggaagtttcaagaataaaagcagtcccatctcagcagtctcgagtgtggtgaaatgtgagcgggccctgtgaggccggggctgagctgtcctctccccctgcaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtgagtactctggccagtggggtggagggaggacggtcagttccctcgaatccttctgaatatgaagaacgcctcttgcacctggtggccatggtaaccatccttgtgagctctgcaaacagcaggaggttacagcccggagcagggatgtgcggtgcccctggcaggtccccaggatatggctacagcttagcaagataaggcctggcgaggaggcccctggctaggcctccctctgaacgtgaaggacgtccccttcctcgtgaatagcttggtcagtgccaccagtaacagacgtggcctgcatagatctcaaataatggcagaagaccagaggggcctgcaggtcctgagaggtctggcccatgctgcccctggctgctggccagcccttgatccctgcaatggggctgcaggagagggcacaaggagtgtgagctgcaggtacagggggtttgggaagggacttgggagcttccctggaggccacgggtgcgtgggaggaagggcagggagccccaggatgagggaaattgtcaagggcctggggctcagcatggagccagatggcatagccctgccaggccaggatctgttctgaagtcttcagctaacttagcaaaagagaggacttgctgggaggtactgggaagcctgggaggtggaaggtgctggggcagcatcaggatgtggggtacaggcagctcccaggatggggactcagctgtggggatgctctgactgggcagcgtgaacacagtgacctgcaatggtctctgcacaactttactccccagagagcaggactgcctgggcgggtcagatgccaccctcctgcccatcactgctgcctgctccatggggagaggggggagctctggcaggaccctgcggtgggccacatggagccaggcagggctggtgcccgtgctggatggggtgagaggtgctcagcgcaggtgtctaggccctccctctggaccctgggctagtcaccgtaagggatgcagggggacctcccagtgaaggcctgctgtggggaggccccgagggtgagcaggagcccctgtcccagcattgattcactgttgtgtacccccaggtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggtgagggtgcccaggggtgtcctgacctgccagctggacaccagtagctcctaccctgctcccacccagctcctcacagctttggggccccctggggttccagacagctaccaggagcaaggccaggacacctgggcctcagccctggacacctgccccggcctccagccccagcttcaccccacagcctgcaggtagttaacgcttcacaccccatcatggctgcatggggctgctgtgctgcagacctttcctgggaagcccacggccatgcagctcttccttctttcagaacccactctcaaggccaggatggtgggggtctctgggcacctacctggcccttgccaactggtctcatgcccatgtgtctcccctcttcaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggaggtacaggctgggatcctcattaagactccatcaccccctgaaacaggtcctgtgatcaacacctctcacacatggggagactgaggccccgagaaatacttgcttggggtcacaccacaaagggggtacagggccaagggccctcaccctgctggccaggctgcagctttctggggtgggtgccacacactggcccaagtgccctgaccactctgagggtctccatggcccgtcatgccccactcgcctacatgggtaccaggtcccacctgtgtctgtacccaggggccctcatcccttggggaccctgccccctggcccttcatggccatgaggtgccgcatccttgccttacctggctgcaccagccgcactgtggaggctctgctcccccaccattccaccctgccttcttgtcccccagctgcccagtgggaggctcttccacgcggctgctgtcatctcggacgccatgtacatcttcgggggcacggtggacaacaacatccgcagcggggagatgtacaggttccaggtgtggggcctgtgggcctgtagagccggctgggtggacggatcccccgtgatgagaaactgaggccaagttggggggcagggcttatccaggccattgccagggccacacctggcaggatggaagccttgggaggagccctgtgggctgagggtgggctgaggtggcactaaagtgggcagccttcgtgcagtggggcaggcagatggtgctggggctcacggcagagtcagtggagggagccgggccaagctgggctcagcaccagagcctcacaggcatcatagcctggcccagggcagagccagggccgacagtggcttgcgttgacagccccttcccaggcctggaggagcaggtggtcagggcagggactcacagccacagtgaggtcagggccagcttcctggaggaggttgggatgtgctggtgggggccagtgtgaggacgcaggtccaggcagagtggagacggcagagctctgctgaggcctggggcccagccgaaggcaagagaggcaggggagccctttcctgctgtggagccggccgtggacagttgcaggtgctgaggctggagccaggctgtattttcagggtggggtagcggctgcttcctctcctcagccaggcccacctgcctcctgggccctgagggtcagcatgggccaggtggggacctcagggtcggcctgcacagccacactggggccaccctgctgtctgcaacatctagtctcactgggcccctcttgcagttctcctgttaccctaaatgcacgctgcacgaggactacgggcggctgtgggagagccgccagttctgcgacgtggagttcgtgctgggtgaggtgggtgcctgtcctcgcaccctgctctgcctgctgtgcctgggcagtgggaatttcgcccctcagaaaaacagctgctggcctggtggtgctgaccttggctggctgggtctctgttctctggggcgagggtcctgtgccctctgccagtgcatcattctttgtgcagaaggaggagtgcgtgcagggccacgtagccattgtcacagcgcggagccgctggcttcgcaggaagatcacgcaggcgcgggagaggctggcccaggtgaggtgcctaaccgccctgccctgacctggcagccatgcctggtgtccactggggtgtccttgagctcccttctccccacagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggtccgcctgggtgggggtggagcagggttggtgtgggctggggtgcgggcagcagagccaaaaggtgggtgctgccagccctgccttactgatgggccccctgaggctcagaggctgcaggtcaccctccttacccatgatcactgcagctggacgccatctgagtcccccgaggccttgttcctacctagtggccccagcccacactcttccatggggggagccctgcgccctgtgccctgccctcccctctccggctccctgagattcgggggctctggggcgcaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggtgtggggtggggtcagcgcaatcagggttgggtggggtgtgctcaggcttaggccccctccctgcccaccactgtgagcccctcgcccagcctggggccctggcttgactctgcctgcctgcctgtgcctgtctgccccaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggtagggagccccgttccccttccctgggggctgggagggatggtgttcatctgcggtaggagattgggagccatggagagcacctgccaggccctcggggtgggggtgggtgccatgggaccccagagtgctctcctgggtacagggaggaaacagatgaaggcagaagcccccgacccatggggcttgccacagtgggctgtgtcctggtgacctgggatttcctgagccaatttctgggggtggacatggggcacctctttcgggctaggatgtcaggtctgatggcccagggtcacggtgatcagtctctggacttctctttgcttgtaatgtcacaggccccttcattcccccagctctccctggggcttgtgctgaccccggttgctggctcttggtgatgtctgcaggcaccagaggccatgcagtgggcctggagggggcttgatcatgaggtcagcgagggggtacagcaagctgggtggaagatgagacgctgggtggtgggctgtgcgtggggcatagtgcttgagtcggccagggcgccgagggaggacagaatgtggctgatggtacctcagggcgagtgaggccttctgcctgggtgaagttttgttcagggcagcaacatgggcagatatgcaggaaggtagtgccgtggggccccaaggccagaatcccaggctgtacctgctcagggaccctcctacccccaggcacatctctgatccaggacatgaaggcatacctggagggagcgggcgcggaattctgtgacatcactctgttgcttgacgggcacccacggccagcccacaaggctatcctggccgcccgctccaggtgggtgggggctggacaggaggggagggtgggcctggatggtgtcttcgttctgctgacggccaggtgcctaccgctcgttgtctgcagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctgcatcctcactccccagtgaactcccaggtccccaccaaggggtcctggcacccacctcaggtggctttgaggcccgctctcctgccccagctaggtgatctgggcccagcgcctccctccagagggtttgctggtgcctggggctgggcctggtgctctctgaagcagttggcagctggcaaggaggggtttgcagccaggaggaaccagtgggttcctgaccctcacaactgcccagaggacggggtgggtcattgctttgtgtgacagttgagcacagacatggaggtactccttatgtcacttcagtaggggtctgaacatggagggtcaggatgcctgttaggcctgcaaggccatggaacagcgctacagatgtacagacactatttttctcgggaggggattcatggttttctttggatcctgaatggggcctttgacccactaagtagttcagaatccatttggagagcatgctggcgtgggggcttggggctccagctgcgcccttccctgtccttccctgggagggtgcgggcggaccagcttcctttagtcagctccttaaccaggccccagctacttgtttgcggccccctactactacggcttctacaacaaccggctgcaggcgtactgcaagcagaacctggagatgaacgtgacggtgcagaacgtgctgcaggtagccccccagccccgtgcacatggctgcagctcccactgagtgggtgaaaggggcagcgcctcaaggtccctgccattgcagatcctggaggcagctgacaaaacgcaggcactggacatgaagcggcactgcctgcacatcattgtgcaccagttcaccaaggtcagggctctggcctccccttcaggactcgcttccccttggcagtggccatgcccaggcagggagggtgcccaggctctgtggtcccctgcagtggtgggccctgggggtgagagaagcagagcagcccatcactggccgcaccttgcttcatccttgggaccagcctgagccctgagcagggtaggccccacagggctccactgcccaccatggcccttaggtggatctggtcccatctccttccggcctgcttgccttacaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttacgaaattgtgtggcagtttctgggactagaatgaatttcatttgtgctcctcggcagggagaggccatacttgcagtgagtcaccccaagacggagctgtttgagaactgcagctgcagcaaggccttccaggttcctgggagttgaaggaaaaggatgctgaggccaggacctgagtgcttgtctccatgttctggccacctcttcctagatttccagggactagcttgttggggctttactacctgctgacatgacccaggaggttgatgattgtcatcatcatccccgtttttcaaatagagatggtagtgaagggggcggggagagggttgtccagcttacccaccaggctgatggggcctgtggacagaagcctgtcatgctcctgcttgagaaccggatctagactgggttttagaagtgttctcaaaggggctggctggtttaagtcagggctgtttcagatcctatggaaagggcgcctggagctgtcttcctggcccctactcacaccatcctgccccttcagagaaccctgtggggcacggagctgcgctagcagggctgactgccacctgtctaccagtagctctgaggggtgagagccaggctccctgttctccttggcaaagagcttggactgagccctctaggagctgcagccactgtctggggcagcaagcttagtactcagaggggctccagcccccagctgagccagacagcaggccctccgtctagaatccgctttattatggcacctggtgggtctggtgggatctgagggaggaagaggctgcagtcttgctgggcagcccctcggtcagtccagcagcccctcaggccatgctgctgctcagctgcatggcaaagtcctgcacatgctccttcagagtctggcgggcatctgcctgtgcccgcttctcccgtgcccgctcctgctgcagcttggtcagtctcaaccgcagccgctgctcccgccgcttgcaggcctgcagctggcgctgggccttgtcaagggcatcaagggctgcctcggctcgccgcttccagagtaaggcgctgcccacctggtagctgtgttcattctggatgtaggctccggcgggtgggggcaggcgcagcatatacgctgagggggagactggccgtggttcgagaggggagggctgccgctctggtgaaggctgggcgctgcagcctgcttcatctgcctgggcacccaaggggcccagtaggtctgaaaaggggctgctaaggccaggctccagcctcccagctggggaggccggcaaagtggcaggtgctgaggcctcttccacaggaaagcaggtgacatcagcaggtggaggtggagaaaatggagttgtgggccctcggccctcggagcagctggtaagggggaagagagagactgatgggctaggctgagggcttgccagacccccctccaccagcccacctgatccacccttaacacccaaacccgatccacaggttctgtgtagcaagaaccctgtccagcgagactgctggcagacacccctagggcccagtccctcagcctaggggtgggagtggggcatcccccacccatatcacataccgcttcctgcatcgtctgagccggctgacttcagcggggccaggtgggtaactgtgtcctttggtcttggttgtccggcgcaacttggagaaagactcaaatatggtggggactgccccctcctttagcctgtgatatccactgcggggaaaagcaacccagatgagctggagagcaagtgctgcctccccaggccaatctgcccccagcagcagcgccgtgggatgctggaaggcatcgtgcaaacaatacgtctggggaacgccaagttacagctacaccaatcgcttccccgcaggactcctcacagtccaggtgtgtggaaagcctgcataagccgagctgggctgaccagccagaaagaattctttgatttgtggacttgctggcaagactggggctctgaaagatactctctggaaaggctcctgttttccccttgtgtcacaggcacagtgatcctgggggtgggtttcactgtgcagagctgggaacaggaaacagcccccttggacgcaggctgctcaagggacttccatgacctgcagctgtcccagtccgccgggagccccacatcctaccccagcgtcggccggcagggaggcccacctgattcccaccagctcaaagcagtcctcctcaaagtgtttggagcagaagtagatgtactcggatgccgggtcccacaggccctggccgctggggtccagccgctggcagttggccagccacaagcctcgcctcgggttgtccttcttgggaagtctgtggagccacaaacccgtgagcaccaggctgtccacagccctgggctcatgctgcccaagcaccccagaggggaaacgcagacccaacacgcgccgccacgagacctccctgcgaccccgccgggtaagcaccaccgcccgggcacagacgaggcaacggaggcctcgagaagaaaagcagtttcctcagcgtcatctggcaggtaacagagtggggcgggtccaagccggctagacttcccgtcctccccttcccgactgcattcagtcccgccgggaccgttccgcttcacctcccacccacaggttcaagcctcctcagtatctgagaaaggcgcgaagcctctacgcagttgcgacccgaggcgagcaacaactagcgcatgcgcacgtgagcccgcggcgcacgcgcgctgacctgtggaaggagatgccgcggttgcgcgtctcgcgcgtgtcccgtgtgcagcagccggcggcggagcagtgacgcggcatctgggaaagaggcgggagttaagtcgcaagcggctctccgggcatccggaggagcctcgcgcctccagccgccgctcctccccaaggggctctggcctgtcgggtcccccccggcccgttgtcgccccaaccccgtcccagccgattctcttgacttctgtcagcggcactcacgctctggccattgctgcgccgccgaagtctcgcgaggggtagcgcgcgccggaagttggtaccatagagactggagagccggaggtgcccccgccaccggggcggggcggggcgaggtcctagctagctgggttagtaagcggcgcgagcgtgcgagtttctgacgcgcccgcgtcgtcccagctccctggactaccagtattgtcgcccacgtgggcttctctttcgtccgctcaggcctcacttttctccgtaaacaccccggcacgatggagcggccccagcgttcgggagcggcccgggagcggaaagcggcagtgtcctgggagcctcgaaagccgcaggggcggcagctcgcctcggaatgacctctgacggaagaaataaaacggggcctgggacgcttgcacgaaagaacccgacaaaaaccagagcccgcactcactctcgtactggggaggtggacttcagggagggttatctggaggaggaatctctcaaagtacaacacaggagaaagacagtatcgcaatacagaaattttattttttattttattattattttcctgagaccggagtctcgctctgtcgcccaggctggagtgcagtggcgcgatctcggctcactgcaaactccgcctcccgggttcacgccattcggctgcctcaccctccacagtagctgggactacaagcgcccgccaccacgcccggctaatttgcaatacggaaattttaataggtaattagctctcctagcgttatggtggggaatacagagggatggttgcctgccgcaccctcccctcactattcttcgccttcttcagcctcagcttccacggaatccatgcccacatcttcataatcctccagagctgccagatcctcgcgggcctcggagaattcccccactgccatgccctcccccacgtaccagtgcactaaggcgcacttggccgaacttatggtccaggcaggcccaggcctccgtgatggccgtggtgttgctcagcatgcacaccgcccgctgcactttggccaggtctcccacagggaccaccgtggggggctggtagttaatgcccacctgtcagagatgggcagcatagaatgaagtttatattggcctcagaaatgggagctcattaaaaatcagagctgtggaccagttccaacactgtgttttaagaattgcttctatattttttggcattatctgttatctatcgacaattaatatcctttgacgacttttttttttcttttcttctccttcttcctccttctcctccttctttgttgttgttgttgagacagggtctagctctgttgcccaggctggagtgcagtggtgcaatctcggctcactgcaacctttgtctcccaggttcaagcaattctcctacctcagcgtcctgagtagctgggattatgggcatgtaagatggagcccggaagacggagatttcagtgagctgagatttcgccactgcactccagcctgggctacagagcgagactctgtctcagaaaaaaaaaaaaattattacccatattacccatacagtaaaacacatgaaaaagaatgagaaccctgtcttgggatataaatacatccaaggtatattgtatactttgtaaaaagaaaagtgagttgaagtctatgtatttatgtgtaaaaaaatccatgtaataacatacacaggctagaaccttgggcagctagggtagcatcatgccggaggaggacaaacgcctgctgaggtggtgaccctgccttgccctgccaagcacgtagcagttagcaccaactagatacagacatactccacaggagttggaaggggcagagagaagggttcgtaccctgatcagggagtgtcctcccacaactctaaggccaagcctatcagcccttccaagtgggagtgctgccagctttctgtttactgtgaccacctgtgtgcagcaattgggtctgtcacctacaggaaagggacatacatatctgctggccactgtcaacatcacctgtataacaagagattaatatgccttgaatatgtacagaatgtttttcaaaggacagaagcagctctggggaagaagaggacttcagcttttcagtcttctgcattctttcagtattttgccacatatcaggttttgttttgtttttgagacagggtctcactctgtcacccagccttgagtgcagtggtgtgatcttggctcactgcaacctctgcctcctgggttcaagcgattttcccactttaagtgatccgcctgcatcagcctcccaaagtattgggattacaggtgtgagccaccgcgcccggcccatatcaagttttttttttttttttttttttttttttttttttttttttttttttgagatggagtcttgctctgtcattcaggctggagtgcagtggcacaatctcggctcactgcaacctccacctcctgggttcaagcaattctcctgcctcagcctccagagtagctggaattacaggcaaccgccaccatgcctgactaatttttgtatttttagtagagatagggtttcaccatgttggccaggctggtcttgaactcctgacctccggtgatccgcctaccttggcctcccagaatgctgggattataggcgtgagccactgaccgcacccagctttttttttttttttttttttgagatgggttttgctctgtcgcccaggttagagtgaagtacaatggtgccatcttggctcactgcagcctcaacctcccgggcttaagcagtcctcctgtctcagcctcctgagtagctagcactacaggaaatgtgccaccatgcccagctaattttttattttttgtagagacaggttttgccacgttgcccaggctggtctcaaagtcctgggctcaagccatccacccaatggattacaggtgtgagacactgtgcctggccaacataagtacttttataataaaaaacccaaatgttcgtatttttttttctaagggtcttgttctgtcacccaggctggagtgcagtggcgcagtcatggctcactgcaacatctgcctcccagtctcaggtgatcctcctacctcagcctcccaagtaactggaactataggtgtgtgccatcacacccggctaattttttgtattttgtgtagagatggggtttcaccatgttcccccaatggatcctgaactcctggactcaagcttttttttttttttttggtgagagagggtctcacttggtcacccagcctggagtgcagtggtgcaatcttggctcactgcaacctccacctcctaggctcaagtgatcctcccacctcagccttccaagtagctataagtgcgtggcatcatgcccggctaattttttgtatttttggtagagatgaggtttcaccatgttgcctaggctggtctcgaactcctaagctcaggtgatccaccgacctcagcctcccaaagtgttgggattacaggcatgagccactcggtccagcccccaaatgtttttaagcatggaaaagactcttcgaaaatagcatatccgaagctgggtgcagtgactcacgcctgtgattccagcacttcgggaggccaaggcggttggatcacttgagttcaggagctcgagaccagcttagccaacatggtgaaaccctgtgtctaccaaaaatacaaaaattagccaggcttggtggcgcatgcctgtaattccagctgcttgagaggctgagacaggagaattgcttgaacctgggaggcggaggttgcagtgtgttccattgtactccagcctgggtgacagggcgagactccatctcaaacaaacaaacaaaaaaaaagcaaatggttgttaaagaatgtatggttggctgggtgcggtggctcacacctgtaatcccagcattttgggaggccaaggcggatggatcaactgaggtcaggagttcaagaccagcctgcccaacacggtgaaacctcatctctactaaaaatacaaaaaattggtcaggcgtggtggctcatgcctgtaatcccagcactttgggaggccgaggcgggcggatcactaggtcaggagatcaagaccatcctggctaacacggtgaaaccccggctctactaaaaaataaaaaaaaaaaaaaaaaaaacgttagccaggcgcgatggcgggcacctgtagtcccagctactcgggaggctgaagcaggagaatggcatgaaccccggaggcggagcttgcagtgagctgagattgtgccactgcactccagcctgggcgacagagcaagactctgtctcaaaaaaaaaaaaaaaaaatagccaggcatggtggcgggcgcctgtaatcccagctactcaggaggctgagtcaggagaattgcttgaaccggggaggcagaggctgcagtgagccgagatcacatcactgcactccagcctgagtgacaagagtgaaactccgtctcaaaacaaacaaacaaacaagaatgtatggtaaatcacactaagactgacaaaaaggaacttaagagcaaagagaattaattcaacaaggtccatctaaggctggactatcttctggggggaggagaggctgtgactttatctccccacagactagcctccctactgtctcacaatacttagttacaataggaaacctctgcacagcatagcatctcccacagtgcctgccagctaaggatgtcttcaccttccaaatgtaacactaattgaaagaaaaattcctctactcaagttgagaggcttaataattagacacagaatggagggtttcacctcctacctgtaacatcttacatctaaggtctgtaatcctcctatgtaacatgtaatgaacattccaggttggtgtaactgttgtagattttacccttctttttcctcttttttttttttttttttttttttgagacagtcacgctctgttgcccaggttggagtacagtggtgatcttggctcactgcaatctctgcctccctgtctcaagcgatcctcccacctccacctccccattagctatgactgcaggcatgcacaaccatacctggataatttttatatcttttgtagagacagggtcgcactatgttgcccaggctggtcttgaactcctgggttcaagcaatcttctcacctgggcttctcaaagtgctgggattacaggcatgtgtcactgagcctggccgattttaccctgttctatgaatcactttaaatctgtcaacttaaagatggtttgcatcaacgtgagatgaaaaagagagatgatctgtgtcaaggtgttgtaaagtggctgagagagggccagacagattcaagaagttgtgtgcgttcagaggcaagttatggccattccacatgggaaaaagaagacacatacctgtgactttctcatatcatttcaatctggaatgatcctggaacttgcaactcctcaaacaccttcagaactcattgagacttataaatgtgggatctatagctttgcctaatgtgggaaaccactgtagacaggggctcttaactaaccatagggcacaaagttgaccaacacaggtgtggtgaggcatttagcctagtcatcacaacagatcttcgagcctgacattctgttatttggcttccaaatacatggtacttttcttttggtagacaactgactgtaagcatagctaaaggagcaccaaatcatcagtctgattgtgtgtgaggcagaggtctctgcttggtttggagaaagggcaaagacctgcctttggtcttcacagtaaacactgcacaatatatttaaaaatctttacagaaatattagtgttgcccaaaattcagtgacaacaggtgaccaagatgatgtaaagtgtaaaaaccactatttataacacaaaaaatgataacatagaacctgacaaattactaaagtgagcagtggagtaatgtggaggacagaccaggacctgcagtcagataatctctgatttctctctgcatcacttgctgcctgtgaggctccagacacctaaagctatctcagcctttgttttcttttcttttttctttttctttcttttttttttttttgagatgtagtctcgctctgttgcccaggctggagtgcagtggtgcaatctcgactcactgcaagctctgcctcccgggttcacgccatcctcctgcctcagcctcccgaatagctgggaccacaggtgtctgccaccacacccggctaattttttgtattttttagtagagccggggtttcaccgtgttagccaggatggtctcaatctcctgacctcgtgatctgcctgccttggcctcccaaagtgctgggattacaggcatgagccaccgtgcccagcctcagcctctgttttctaaagtgtaagatactggtaatattgccccatgaactttaaagggtagtggttaaggtatgagggaacataaagtatttggtaaagtataaggcggtaggaaataaattactaaaattattatccttgcaacctagctgacgtgaaaaggggttgtctccataaaggatgcgggccttcaggggcagcattattctgcaggtctcctgcttcctgatggcacaaggactccacatcacccagtcctaccttaaatccaatcggacaccagtccacaaactggttggtgtgcttgctcttgatggtggcgacagccgcactgacatctttcaggaccacatcccctctgtacaacatgcagcaggccatgtacttgccatggtgagggtcacacttgaccatctgattggctggctcgaagcgggcactggcgatcttggccacggacagctgctcatggtaggccttcttggctgagatgaccagggcgtaggtggccagggggaggtggatgtgggggtatggcaccaagttggtttggaattctgtcaagtacacattcagggccccatcgaatcacagggaggccgtgatggaggacacgatctgcccagacgactgaggttggtgtacatgggacactcgatgtccaggttgtgctgacatgtcataggtggctttgctgtcgactatgaaggcacagtcagaatgttccagggtcgtgtaggtggtcaggatggagttgtagggctccgtcatggccatggagacctggggggctgggcaaatggcaaactccagcttggacttcttcccgtagtccaccgagagccgcttcatgagcagagacacgaacccagagccagtgccgcccccaaagctgtggaagatgaggaagccctgcagtcccatgcacagatctgcctgagagaaaccagacaacgtaagccaatgcccgtgggagccacaccaccaacctccaccaagccggggccacttctctttgcctctgagagttgatacggattcagaccatccataatgaacacgcatcacactttgaagcagagaaaagcagacaatacagatctatgcacaaatcaccacgcacacttcacagtaagacgttgcagaggtctaggaaggctggtttgaagaaatacacagaagaaaaacggatggactaaccagagcgctcagccagcctgctggactggcacccgtggctacagacactcttgtttagcaccatggagagctccctgcacagaagcaaggactcagggcattgccccctctctacctgagaactagactcagcgcccagcactggatttgataatacaggtactcaaatacatgtgctttcctctttactcagacacttctagggctggcagggtcagacagtaatcccccactttgtggggaggccctgtttttgctgaacagctcaagggcaggaagattctttcttccacacacccctgcaactgccaatacttgttctgtgtgacccttgcagccatcctatgcggtaggtgctaccattgccatggatcaagtggggacgcacagatccaagctccttcacctctcaagggagttgggccctcccacagatctcttggaggaaaaaaatggccttgctgggcctgtcgatttccagtccccacccacctccctcatgtacatgtgtctgtttgtgaaaccttcatagcaccttagcttccaggccctccatcccggctgcctctctggcacttgcccttttactgtgcgggtccaaagagacacctatgttcagtttgtcaaagtctgaaataagcctgtcttttaatttcactgactcccagtagtaatttttttagaagacaaactgcttctctggcagttacactccagggccaattctcaaaggccaagtctggtgccaccccactccctctaagctgcttgagccagatgagagcttctgaaatgctgcagaaaagagctctcctggggcatccattaaaatgcagattcactggcattcccctaagagtttggttcagcaggtccagggtcaacatctgcatgcctcacccagggtcacaggtgattgttactattattggaccatttgaggagaggcaggtagaagtgcaaattcctggcaaagcaaacactcaggggcatgagagtgatgagaccaaggaatcccaaccatgtcttctacctcacctggaacaaaatctataccctttttgccacggcctacagccctgcagccctctgccctctccaccccacagcctggccacgcttccctggctccctagcctaggcacactgctgtctgccagtctgggaaacaggcccgcatgctcactgttcctctgcttgaaatgctctccctctgatcttgccatggctgactccttcccaccctgcacatttcagcttaaatgtcacctcacagaggcctccccagccacctctttaaagcagggggtccccattcttctctagaagcataaactatttgtttcttttgcagtgccaataattactcagaatgatattgttaacattgtcccttgaggtcaggaacttggttttgttcaaggtggatccctggtggctaagtcagtgcccagcacatacagcagcgcgcaatgagatatttgtggaaggaatgaagagttccgtgtggctggagtggaagaggagtggggcaaggtggggtgtggggagcaggaaccagagcacatgctccctggcgatgtgcagcgcggtcctgccaacccccacccatccctgccccaggaagctgagctttcatggccatggtgccctgcgcaggcattacctgcttggtcattcagctggttgtagctcaggtccagggacttcaggtctgtgtgggccagcaggagttcggcaaggtgctgggccgcctgctcctccaggccattccctgacagctgcatcttccgcatggcctggttcactgtgagggcggcacagagggcctgggctcctgccactcccagctggttctccaacaggtccacatctgggggacggagccactcctcagccagtgggatgcaaagccaggtaccacccccctcccccctcttctgccatcccccaaacctccaggtctgaggcagaggaaaaggacttacaggttaactgtcctggggttgcatggtggctctggctcccaatggctgggtcccctctgcccctgacctccccctccctgtgtgcccaccagcttctgtgtcaagcggttaaaactgcctacctcctggtactgtagagactgctgtggtggggggcagccaccccatcaatgattatgtctggcagtgatatcaccacccacttcagaagccctcactgccccattgccaggattggcaataatagcccaggtgactgtgcatggagcacttacatgggtcacacactctgctgatcacttcaggagtgcatttcacttcatgctcaccacagccccaagcctatgaggtcttgtgggggccatttcacagattggaaactgagctgctttcataggtcaccccgttttctcagtggcagagacagcatttggattcagcttcaatgaactcccaccttgcccacccctttcttgaacttccccgcccccaactctctgtgttgcaggactttccactctgcattcaggcactggggagtctcccatgtgcagggcagggcaggagaatgggtgccagccaacaaggaaggagagtggtggggtagggtggatgaggaagggacttgtatccagcatcagctgcacagcagagggtctaactccaccccacataccccctcctgtgatgaggcccctcctctatccaccagcaacaccagcaggacccaggtgacatggcccagctttcaggggtggaggcacatccctgaggaaagggaggactcacgcctgcccacctgccccagacccagcacctaccgcagatgctgctgcttttgctcagggcacctgccagggcctctgtacctgccccatagagcccactgtcccaaaagttcagccacttgacatatggattggagctcaatgaggaagccagagaccggcgccctgggacagacagagcaaacacactggccactatcctggctcatgctccagggctcagcccgctccacgtcccccacctggaaagtacccccctttccacctgcttaagggacacatgcttctccttttaggccccacctaggtgtcccccacccccacctctcccagagcccccagcgggttagaagcctgaaggctccccaacccttcatgccatctgtcatagcatcaatcccatctgtctctcagatgtcgagggtagggcatgcctggcacaggcagaagctggggagtacaggggacagactcaggggcactcccatggctgttgtctcccggggcctctccctgtaagcctggacccagtgtccttccagtggtacctggggccccaggccaccgtgcagcaggttcagctctggggcactcccttggcacagaaagcagaagatgggcacaatgctatggatccagcaagacctcaggtacagggtgtccccgaccagttctccaagtccatgggtgcctggtaggagacagggggatgaatgtgaacccctgcatggctatagccacctgcctcctcccctgccctgcatcactacctggcctattttttgcctctagaagcactgcttcctatgctccttaggaccactgcccgcatatgacagataagaacatcgaggctaaggcaacgcaaatcttttccttaaagtcatacagctgtcaaaagaaagctggacaacctgggcaacatagcgagataaaaaattatttaaattagccagatgtggtagccccctgtagtctcagcgactcaggaggctgaggcaggaggctcaccagagtgcagagttcaaggatgcagtgagctatgatcctgccactgcactgaaagctgggtgacagagcaagaccctggctctaataaatgaatacataaagtctcacagctagtggtagctaatcctgccagagtcaggcctctacctgtctgatgacaaatggcacactatgtcttttaacctgattgcagaccacaaatgttttgtgaatattttccccagggaaaaaaccggaagtagttctaaattctatacatccattatattagttttacctgtggattgggaaaacccagctctgattgcatttcagggcgggacagcctttggtgcactgtctggcgggattttccattttaacctccttctagaagcgccttctcatggtaaagttcctgatgccgccaggagcgccgaggagagggcagggggctggagacgccccgcagagggctacgtgccctgctggacagaggtctcctgcctcctcggcggcgccagcccacctcccacaacccctgcgggagaagcccccaaggggaggagacgggcctggcccctgccccgagcaccttccgtctctaggtcggagtctgaatcggccttgggaccctgcttggcttcggggacccctgcaagacgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgctgtaggttgccgtagaaaccgtggctctcctgcgctgaggctcctcgcctgagaggataaactgcacgcgccacgggctatgcactgggctgggcgccttgtgggcatcctccctgccttcctagggggttccagcatcgcccccctttcgtggactgggaaacacgcctgactccaggacttgtgttgtcctcactgcactggggaaggtggcgggggcagcttttcaggagggcctggggaacttcgcagagccaggtcaccctctcactctgtgcctcttagttatcttgcatgctctggtctttgcatacgctgctccctgcaccaggaacctccatccccatctttgtctgcttgtcgaacttcagaaatctgcaagggtcagcttagaggtcacttcttccggaagctttcctcaacaccctccccgccctgctgctgctgccctcaggccctcctctcacagcactgataacagctgtccgtctccaccctcccaccacctccactcccaccccaggaagtgaggccagagggcagggacagagctgctgctgttctctgtgtgccagggcccagcaaagggaatgtagggagggtgggaggtgcagggcagctgggattaggggttgagggctgggtgttggaggctggatctggatcctgctttagtggaagtgtccctttaacagcaactggcctggcctggctcgggccctgctttgcctcctgttcagctgcggctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtaagagagaagagcttttggccaggctggaggggcaagggaagaggtggggggtggggcttggtcctgctgggttgaagttgagggttgggctgtttaggggctggagtggaagggggcagattgggacggggttggggagagctaggcgatacaagacaggagagcaagaacaagctgtgtgtttgtcctgtgtgtccacttgcctccttcccaggcccccacccaggccccacccagggggcacatgacatagtccttaacatctgtgagagctggagcactaggcccccagagagaccaccagctgtatctcgggtcaggagagtctgtaagggggaagctggatctagtcaggctgggggtgggtgctggctagtgaaggtgattgtctgagggcattggctctctgatgcatggctggagcttctgtctcattcagggggtctggagtgggaagtggggccagagaggaggtggggccttcgatgttgggccgggagcctgtagggtgtggggggagaactgagcatgtagggctcagctccgcccctgtcactacacgctggggacacaccacactgcccgacttctcctccccaggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgggggccctgatgttgctgacgggggcgcaagtcctttccccactgacagcctgaacacccgccatgcagccagtgtgtgcgagagagaagcatgtgatgccagagacggctgcgggttctcaggaagggcttcacagaggagtggcacctggacaggactttcagggatgtgtaggaggttttggggtggaaaaaggggccactcaagaagccaggccagggttggacgtgctggctcacgcctgtaatcccagcactttgggaggccaaggcaggtggatcacgagattgagagtatcctggctaacacggtgaaaccccatctctattaaaaatacaaaaaattagccgggcatggtggtgggcgcctgtagtcgcagctactcgggaggctggggcaggagaatggcatgaacccgggaggtggagcttgcagtgagccgagattgcaccactgcactccagcctgggtggcaaagcgagactctgtctcaaaaaaaaaaaaaaaaaagccaggccagagaaactgcatttccaaagactgccaacagaaaagaagggagtgtccaggactaatggcttgagcttgagagtggtgtgaggtgctggggcatggaacttccctgtagccctgctccctgacctggggcactacggtcaggtgctgctcctcccctcttctcggctgcgttttcctcctccctccacccagctcatccccagcctcaactgccacttctgctcctctgatgcccagggtgtattcccagtgatcacctgcccagagcacagctgtcttctaggtgcacacccacatgtccaaagatcaattattttcctctcctggcatggcctctgtgacgcccactagtcatggtggctgtgacatccactagtgcctcagccagacccgtgactcaccctggaccccttcctgtcccttccaagatttttcaccactacccatgccatgccatgcatgagactatggcctcctagagggtccctagatgcccctctcgcctcctcccttactgctcggtgcacaccacgcagcagccaagctgaactttcacaccaggcatcatgagagcctgcagcgcctgcttctaccctcaggaattcccccaaccctgcccatgacggtgtccacactttcctcccaatcctaatggctgccactcccagcaccatctggccagccctcaccttcccttcctgggcatacattccccaaattcacagtgctctcacgagcagcactggagggtcagcctttctttccaatgtcctcggccacccgttgaccacagacacagctttccctcttctcccttggcccctgccatgccagtgctgctgtgtgtgagatgggagactcacctcgtctccatcctgagcaggtgctgggcccagctctcccttggatcttcagtactagaagcagcaggctgttggaatattctggttggagccaggcatggtagctggagcctgtagtcccagctacttgggaggctgaggcaggaggacctcttgagtccaggagttagaggttgcagtgagcactgatcacaacactacactccagcctgggtgacgaagtgtaatcctgtctctaaatacacacatacacatgcacacacacacacaaattttggttgagacaagagacttgtctcaagagatggacatgggcacaaggcttcctggtctcaaaaatggccagaaccactgccagcctcccatctctgcttcagtctgccttacagggggacagggttaatgacttgatggggccaacatcccttccctcataaaccaggctgccggcttccggcctttccagtcaacacgagcccagccaggccaaccttgagacttgcctcctagggagagaacgtgttcttcttggtgaccaacttccttgtgacgccagcccaagttcagggcagatgcccagaggtgagtttacccaggatcctcccagcgggtcccttgttcctccatcagccccagggggccacccgtgtttccctttccccttcccaggtggctgaaggctcagcctgtgctcggtgtcccccaggcactgggctacatcttttcctgaatcattatgttcagtcttcacatatcccctgcctggtaggaagtcctgtgatccccatttcagaggagaagactgaggctcagtgaggttgagtcactttcttaaggcctccaggcctgtgggtgacaggaccccgagctctgggcagcagcagttcccatgaggtgtccaggccctcccatcctggtcctgcctctgggtactctccaggttggtagtgtgacacccagagctgcgcacatgctcagggaggttctaatagcaagagccaagctggaatatcacctccccttgtctgtgcccagcctctattaatatgtcctgaggcagctttcatctttgtgggccaacacagcacactcttgctcatggtgaattcaggattgcttatgatttctggatagttttttttgttttatttttgagacggagtttcactctgtcacccacgctggagtgcagtggcagatatcagctcactgcaagctctgcctctcaggttcacgccattctcctgcctcagcctccggagtagctggtactacaggcgcctgccaccacgcccagctaatttttttttttttttgtatttttagtggagacggggtttcacggtgttagccaggatggtctccatctcctgacctcatgatccacctgcctcggcctcccaaagtgctgggattacaggcgtgagccaccacgcccggcctgatttctggatagtttttacatcaaccgtggtcaagccagagtcccccaccttgttcttcttcatttctgatccagaaatgctgattctccccctgacatttcaccttttccccttgcctggggatgtccctgggatcctgcatctgtcacagagcatgctcattctctccagctgtgaattttgtttgaactattgggactcaggacatagtcctgaaagtttacctccacagtgacatctttaggcaagtccaacatttacgtgcctcctgggctggagggtcgttgtgcagacagctgtcccctgagccctggtggctggtcctagcacagttgctggagacatcccatgtccgtagttggaaatatgcacaaaggattgcttactctttttgtttgtttgtttttttgagatggagtcttgctcttgtccccaaggctggagttcaatggcacgatctcggctcactgcaacctccgcctcctgggttcaagcagttctcctgctcaccccctgagtagctgggattacaggtgcccgccactgtgcccagctaatttttgtattttaagtagagacggggtttcaccatgttggccaggctggtctcgaactcctggcctcaggtgacccaccagcctcggcctctcaaagtgctgggattacaggcgtgagcctgccgagagcttggtcggggagacctgaacccagcggtgctaaaggaattaaagacaaacacacataaatatagaggtgtggagtgggaaatcaggggtatcacagccttcagagctgacagcctcgaacagatttacccacatatttattgacagcaagccagtgataagcattgtttctatagattatagattaactaaaagtattccttatgggaaacaaagggatgggctctggttggttagctgcagcaggagcatgtccttaaatcacagatcgctcatgctattgtttgtggtttaagaacgcctttaagcggttttccgccctgggtgggccaggttttccttgccctcattccggtaaacccacaaacttccagtgtgggtgtcgtggctatcacaaacatgtcacagtgctgcagagattttgtttatggccagattttgggggcctcttcccaacatgagccactgtgcctggcaggatgtgcttactcttggtgaacccacacaatgtccttctctttcttaatgctcagatgtgcatttagtgttcagtttgtagaccgttctgaaatttggctggatctgtgggtctgtgtttttcagaatctgtgcaattcctctttgtctgcaaccacacttctggctcttcccatgaaacgtcagggctgggtcgtaattatcagatctgacaacctggctttcccggaagaccagagttctgccagctcctctagggatcctggtgcctgatccctcccttacatgcaccatgctctttatagtgtcacctccctcagcagacaccgctgagcctccccgctgggccagggggctagctaggctaaattcacaaaactccatctcccatacttcaaagaccacccacatggacagcccagcccaggtggcaggtcctatgatgggacagaggctgtaggtgggggacctagggctgcacttgagcagaatcttttttttttttttcttttttttttttttgagacagagtctcgctctgtcacccaggctggagtgcagtggcgtgatctcggctcactgcacacctccacctccttggttcaagcgattctcctgcctcagcctcccaagtaggtgggactacaggcacacaccaccacactcggctaatttttgtatttttaatagagacagggttttgctgtgtcggccaggctggtctcaaactcctgacctcaggtaatccgcccaccttggcttctcaaagtgttgggattacaggtgtgccaggccaagcagaatcttaaaaaaaggtggggagaagctggtgagcaggtggatttggttgaagcaggatgtcgacacagagggggcttggtgggtaaaggccctgagctgtgtgaggtgaggtgcctttagggctacctgccactgggtggagctgaagtgaagatttggactggggtgggaagaaggtagttcaggatttcaggggcccctgtaagccccactaaggagctaaactgtttttgtttgtttgttttctttttctcttttcttttttttcctgtagcaatgaggtcttgctttgttgcccaggctggtctcgaactcctgagctcaggcaatccgcctactttggactctcaaagtgctaggattacaggcgtgagccactgtgcctggcaggagctaaacttgattagaggaacagaagagagccacacgtgggctcagaggcagggtgctcagtttcctgcacattgggatgcaccacttgggctgctgggcataggtggatgagggtatgggaagacgtgggggccccactggtggtcactgtggggtctagttggaggagacggtagcccagctggggtgaagaggagaggcagacacaggacataggtagggacaaagaagcagagcatgtggctctgctccgacctccacccaatcacgacggccctgtctttcagaaagtcccaccgcctcattctggcttctcagaggccctcagccttccttgcgcccctggtgctggtgttcttcctgctgcccctgagctgagtgccctgggcagcagtgtccatcctcagttggggcaggaccatgcctgggagagtgcccgatgctcaagggtgccttcgtctctggggtctgggaccccagaaagctcacctgtcctccccttctgccagagccccatagtcctatgcctctgtgcaggcattaatgtccccaggttacagaagagcgagcaggaaggagtagcctgtggtccctcagcaagggtgtggggtcctgcttcaatacccaagcccctgactctagggccctgatctttgtcagctatgtccccatgccgggcatcaaaaactcaccctcccaaggtatcttcaccttccctgatctgtcatccaaattggaccagaggagctagacctggaagaatcacttccgcatccaccagggacagaactgtcaggagggaaggggcagggtgcgttgtctcacgcctgtaatcccagcactctgggaggctgagacagaaggattgcttgaggccaggagttaaaaaccagcctggtcaacatagcaagactccatctctacaaaaaaaaaatattaaaaaatcagccaggcacagtggtgtgtgtctgtagtcccagctactgggaatactgaggtgagaggattgcttaagcccgggagggcgaggctgtagtgagccatgatcataccactgcactagagcctggacaacagagtgagaccgaatcactaaaaataaattttttgaaaaaggaggaaaggggtctccctttgtctttgaaatacagtactgtaccttcatctggccagggcattgctccgctccctcctctgaccacctccttttatttgcaccctccagctttcctgtgtggccccacactcagggtactctggcggcggggtggtgaggttgtttaaggtgggaagggggcctgtccttcccaccttgaacctccctgcctttgagactgggctgtggaggggagacatcccctgtgccattggtgactgctctctctcccacctcagcacccgtccgtcccactggctaactgctgggtcgacgaggactgccccgaaggggagggaggcacacacagccacggtaactgtgggctctgtcttccagtgcccccagcagggtgggggccgggctgggatcctgggtggctcctgagtgcaggccctgctcgcctctgtccctgcatctctctttctgccaacaaccccctggctgaaggcctccccaggcctgcagagatttgaaggtctggagttcatcttttgttttctaggtgtaaaaacaggccagtgtgtggtgttcaatgggacccacaggacctgtgagatctggagttggtgccccgtggagagtggcgttgtgccctcgtaagtgtccccacaatcccctaccccaactggcgcagggccccaggcctggcagaggctgtcacctcccttccacctgcaggaggcccctgctggcccaggcccagaacttcacactgttcatcaaaaacacagtcaccttcagcaagttcaacttctctaagtaagcagagtgggtctcatctgccccaagaccctccttgtcccctacctcatctgacctttcccactcctcccaggtccaatgccttggagacctgggaccccacctattttaagcactgccgctatgaaccacaattcagcccctactgtcccgtgttccgcattggggacctcgtggccaaggctggagggaccttcgaggacctggcgttgctggtgggtcccaagttgggggcagggttcctagagggctctgggagagggtcccgggcccacccaccggtggaaaagctatgtgctatgtgcagggtggctctgtaggcatcagagttcactgggattgtgacctggacaccggggactctggctgctggcctcactactccttccagctgcaggagaagagctacaacttcaggtgaggccccactgctcccagtgcccagctgctgggcccatcgccctctcactgtggcggccaggacagaccacacccaggcccaggcctctagatattccactacgtgtgcaagggggtcccaggagcaggagagagctgttctcaaccccacatcctccagcacaggctccgtcctgctgccccaagtcctgagccctccaccccatctgtcccaggcccctgcccagctcaggctcctcactgccagcccttcctccaccccacctcgcttctagtatctcccctccacagcaatggggtgtttcatttttactttccccttctccccttcagctttgttttttttttttttaagacagaatctcattctgtcacccaggctggagtgcagtggcccgacctcggctcactgtaacctctgcttcctgggttcaaccgattctccttcctcagcctcctgagtagctggaattacaggtgctcgccactactcccagctaatttttatattttggtagatagagatgggttttcacaatgttggccaggctggtctcaaacccctgacctcaggtgatccacccacctcagcctcccgaagggctaggattacagacgtaaaccaccatgtctggcctcccttccgcttttacctaaactttttttttttttttgagatggagtctcactctgtcgcccaggctggagtacagtggcgggatctcagctcactgcaagttccgcttcccgtgttcacgccattctcctgcctcagcctcccaagtagctgggactacgggtgcacgcctccacgcccggctaatttttgcatttttagtagagacagggtttcaccatgttggccaggatggtctcgatctcttgacctcgtgatccacctgcctcagcctcccatagtgctgggattacaggcgtgagccaccacgcccgacctttttttttgaaacggagttttcactttcttgtagtccaggctggaatgcaatggcgtggtcttggctcactgcaacctctgcctcctgggttcaggtgattttccagcctctgcctccagagtagctgggatgacaggtgtgcaccaccacacccaactaatttttgtatttttagtagagatggtgttttgccatgttggccaggctggtctcgaacttctgacctcaggtgatctgcccacttcagcctcccaaagtgctgggattacaggcatgagccaccaagcctgttttttttgtgttttttttttttttttttttagatgaagttttgctcttgttgcccagactggagtgcagtggcccgatctcggctcactgcaatctttgcctctcgggttcaagcaattctcctgcctcagcctcctgagtagctgtgattacaggtgcacaccaccacacccagctaatttttgtgtttttactagagatggggtttcaccatattggtcaggctggtctcgaactcctgacctcaggtgatccacctgcctcagcctcccaaagtgctgggattacaggtgtgagccactgtgcctggcctcaagtttcataaattgcatttattatcatgtctttgagtcttctaagcagatctattggatccttctgccaccgagcgtcacctcgtcatgcaggcaggcacacacgaccaccaggcctggggatgatgcccctcaacatagctcactgcaccccgtctgatctggcttccccaacctccccagcccttcgaaaccacgtggggctggctcccacccacatcctgttcccctgacctctgtgctggcaaaccacctgtgtgcatgttccttcaggcccagcctcatgtcccctccaggaagtctaccccagttcccagggaagagtgagttcccatctctggaatccctcagccctgagcctgccccttcacatcccccgctgctgggtctgtttagggactcctctgtcccccgtcctctcagcaggcagggaacttctgagggacaggtcttcgtttgctttttctgttttctcaccaattacatagggctgagacccaggactcaggcttgggctgggggtttatagagtcaattgacaagttggacagaggtctggcagggccagccccacctgggggtgggcaaagcaggtcaccagagccttctttcctgcccacaggacagccactcactggtgggagcaaccgggtgtggaggcccgcaccctgctcaagctctatggaatccgcttcgacatcctcgtcaccgggcaggtaggcacaggtaggggtcaggccggggatgggatggggcaggcagacagggctggaggaggcatgaggctgacagtcgtgggctgagaggttcagctcagatctctctcaggcagggaagttcgggctcatccccacggccgtcacactgggcaccggggcagcttggctgggcgtggtgagtgcgagcactgtgggcacctgcaggctgcagtgagtgctgctgaccagggtgtgtccaatgcatgctggagcctccggtgcctgcacattgagtctcggggtgcaggctggggaggtggcaggagagcaggctcgggggctggaacatgggttggccctgcctctcccaggtcacctttttctgtgacctgctactgctgtatgtggatagagaagcccatttctactggaggacaaagtatgaggaggtgagctgaggtcgctctgcttggaccctgggttctgccacacttaggaagatgttggctggatccctgacctgctgtcctcatctgcaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaacaagaaggctctgggcagagtccatggcaccagcaccagccaaggcccactcctgaagacccgaagcccagcccctggatgaaggtcctaaggtcctgaggactccccagcctgtgcaggcctgcaaacccaggctgcccacaacagaaggggctctcggcttgtctggcctctctggcctcccaagcaggtgtgggagggcggggcaagtgtgggctgatcagctactccatatggccagggtcctgtgctggtgcctggctggggggctgcatagcctgcactgtctcctccaggctgcccctggggaataccacgtagtgtgtggagttcagccctggcagctcccgctggttctccttgctatgccggatgccatagccgaaatacactgcaagtcctagacagggcaggaggcagggcatgagcctgaggtacaggttccagcccttcctgtcctctttgccctcctcctgaccccggtcccagcctggcccccactcacccatcagcagccagatggagaagcgcacccaggtcagatagctaagtttcagcatgaggcagatgttgaggacgatgctcagggctggaatcaggggaaccatggggatctgaggaggcagaggcagggcagggctgggccgggctgcaggaaagatctgccagcccagggctcactttctcgggaatccatagagcctttgttcctcacgggagattgtggagacatgtgctcactcaccatgcagaaaggggtgcgggatgggtgtgtggtcctccccagccccgtgagacttgttcattctgggatggtagtgggggaaggggaggcagctgcctgggccgagtgtgagtgggtgttggctaggggaggtacctgaaataagtcttcccgatactgttgctggtgagcccccaggacaaggaggctgagcagaaacatgacactggtgagcaggagcagcaggatgtaaccccagtgtgggaggtgcagggtcgagttcccaaagacaagcacgcagcctatggtgatggctgaggccaacataacgccaagcgcccaagtcaccactgctccagggctgtacccatccaagaagcccaggtagggcctcagggctggcttcagctcccctggctcagggacggaggcgtgtacagtgcccaccagctgtaggtggtctgagaaggagctctgctgcttggtcagggggccagggctggctgggcctggggagctgggcggggaagacttctggaagcgcagcacaatgatactggtggccacgaatgtgtaggccaggagtgtgccaagggacaggaactgaaccagcgactccaggtccagcagcagtgccaggaaggccgtgaggagcccgaacgccagggtgcccgccacaggcacctgtgtccgggggtgcacatgggcaaacacctggaagaagagcccatcggcggccatggcatagacaatgcgtggcagggagaagaggaggctgagcaggacggtgttcatggctgtagcagagagagtggggagggtcagcatggcggagaagcccaccaggggcctctgctgggggtcggtgcatgggtggctccttgggaacaagggcatgagcttgtctgggctctcagagtaagcatgagtttgtgtaggagtaatagattgtcagcgctttgcccaagaacaggacatctgggttaggtcacaggcccactggagcatcggatgagggctgagtccctctgcctaggaaataatctataaggacatgcccagaactaatatgctatggaccatgtgtggggcggtcccttccaaagtttctgaagaaactttttttgaagtgaagagtttctaataattagcactttccttgccccattatgcaactagtaaaacagccccagttgaaggtgcattccccaagaatctgaggacaaggtcccccttgctcttttccctgccaccctgcccaggaagagtctctcaccgcagatggagccagctgccacgatgaagccagcccacctgtagccccgctggtagaaggcatctgcaagcgctgagtcggggtccaggctgtgccagggcaccatgagggttagcacggtggagacaaggatgtaggcaccagctgcaatggcaagcgagatggcgatggccagaggcacagaccgccgtgggttctgggcctcctcactggaggcggcaatgacgtcgaagcccacgaaagcatagaagcaggaggcagtgccggccatgacgccggagaagccgaagggtgcaaagccgccttcgtcagcgctccagttgtgaggctgggccaggatgaagcccaggatgacaatgaagagaatgacaagcaggctgatggccgagaaggtgtgattgagccaggaggacacgcgggctccacaggagacaaaggcagaggccaggaggatgatgccagcagccaggaagtccgggtagtggcccaggaggggcacctgccaagaacccacgtgggtctcagtgaagttgcggatgctgtggctgaacatagagtccaggtagccactccaggcacgggccacggcggcgccaccgatgatgtattcgaggagaacattccagccgatgaggaaggcccacagctcgcccatggatacgtaggtgaacaggtaggcagagcccgtgcgtggcacacgtgccccaaattctgcatagcatagggctgccagcagggaggccacagcggccacaccgaaggacaagagcacagcagggccagccacctccttggccacggcacctgtgagcacgtagagacccgagcccaccatgccacccacgcccagaagagtcaggtccagcgtggacaggcagcgccgcagtgacgtctccatggtggagtcctccagcggcttcaggcggttcagcttctggcataagcgtgccaggctagcaatggtgggcagcccccgggccatggcaggtggccgagaagagcaccgagccagctactggaacctgctagggccagaggggaatgacaggatgcgtagccggggcctgaccagccttccatccctcctggtctgaccacccccagtcctctctctgtccctgacctggggacctggacaccctcaccaggggcctgctggagagctggaatggggcaggtgtcagaacctgtgggcaggaggtcacaggaagcctggaggccctgtctgcatcccaggcagcaaaggaggcctggtgaggccccacctgctcacccgctcggtggccctgaggggtggggagggagcagctccagggggagcagggtgagaggctgggaacggctcagtggtggggtcccagagccaggtgaaaccgaggcttccccagagtcgagccggacccggaacaggagccgcggctctgcgtcggggcgggtgtggcccaggcagccacctggccacagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaagccctgtgactgtgactcagtcacagatggagaaggtcagaccgccggctgactgactagcctaggtcagttcggggaggttaagggccacgtctgaaagtccgcagcccaccttctttctactgcagcggacacccttcttgatccctcaccccagtacatgaaccccacccagctgggccccagacaggccccacagcaccgtcatgtgagcttcaggcacagtgagttagatgaagacatgggtctggcagagtggcctggggcggtccctgacctctactcttacaatggaagagactgcagccttttgagagagttctgcgaattgagggaatgcattctggctgttttgagcctgcagctaccacgtcctgcaaggaagcaagcagcttctgggaccagcctgcagccctcctgtgggggagtagagctcctcagaccccagtggcagcccttcctagcctaggcacctctggcaggccgggagggccctatgggaccccaatagcagatccccacttgtgtttatcagcgacagccactgtgtcctgagtactgcattccagtgccccacgccccaggcaggcagctatgcaacaatacacctggctaattttttaattttaatttttttagagactgggtctcactatgctgcccgggctggtctcgaactcttggcctcccaaaaggctgtgattacattcatgaaccatggctcctggcctccccagaacgctatactagacatgtgttcaggcttacatgtggtttgtggaatggaatcttaggagcatctgcagcctatccagcctattgggctggtgacaggatgatggactcccagacaagatggtgccaatttggaacattctgcctcggccagaatgccaataccttctaatatttggctggtattgtcttgaggaacttctcagatggctcccacttccggtgggatggtagcttccttaccccatccctgtgttgcctgagcagacgtcccttgtcctgaaatgtcaccacaaaagtctaggcacttcaggccagagggttaggcagatttgtaatgggagctccccaaaggccttaccaatgactgccttattgctggtgtccagtgttttggagtgttgactttttatctacctggagaaggtgtgacaccacaccctctgccacaggcaccaacatacaacggatatgtgagactaagcagggctgatgcagtaaattgtacatttccagagatatttccctcactactgagtgagacagctacacagagcaaccccacagtgatgcagtgaagacaaaccaccaggaaacaaaaactttctaactcattctgcaaggccaggattaccctgacactaaactcaacaaagacatcacaagaaaagaaaaccacagaccaaaatcccttatgaatatagatgtagaaatccccagcaaaacacagtggactcttgaacaacacaggtttactaatacatagatatttttcaaccaaatgtcgatcaaaaatacagtatttggctaggcccagtggctcacaccggtaatcccatcactttgggaggctgaggtgagaggatcacttgaacccaggagtctgaggctgcagtgagctatgatcctgtcactgcacttcagcctaggtggcaaagcaagaccctgtctccaaaactactaaataaataaattaaaataagtggtgggtgcctgtaatcgcagctacttgggaggctgaggcaggagaatcgcttgaacccgggaggcagaggttgcaatgagctgagatggcgccattgcactccagcgtgggtgacagagcaagactctgtctcaaaaaaaaataaaaaacaaaaaacaaaaaattcatatggaaatgcaagggatccagaatagccaaaatacttgggtattttgcctgggtaacatagggagacctcacctctacggaaaggtaaaaaaattatatgggcatggtggcatgtgcctgtggtctcagctactgggagtcgggggtggtgttgaggtggaaggatttcttgagcctgggaggttgaggttgcagtgaggcatgtttgtgccactgcactccagcttgggtgatagtcagaccctgtctcaaaaaaaaaagaaaaaagtaaagaaagaaattaaaggcaacataaataaatggaaagacatcccatgttcatagactgtaagactttaaatataaaatggcagtattccccaaactggtctacagattcaggggttgcatagattgagtgcaattcctattgaaatcccaactacctgttttgcaaaaatcatcaaaattcatgtggaaatgcaagggatccagaatagtcaaaatacttttgaaaaagttttggaggacttacaattcctgatttctaaactgattgcaaaatgactgtaatcaagattgtggtggtgacataagagtagacacatagatgaacggaatagaattgacagtccacaaataaacagttacatttatcgtcaagtgattttttaaaaatagactttattagctgggaatggtggtacacgcctgtagtctcagttactcagaaggctgagttgggaggatggcttgagcctaggaggctcaaggctgcagtgagcttgatcatacctgtgaatagcctcttcactccagcctgggcaacatagcaagaccctgtatctaaaaaaaaaaaaagttgagttttcagagcagttttatgttcacagcaatattgagcagaaagtacagttcccatatacttctgctcccacacacgtgtagccccctctcccactactgacatccagcaccaaaggggcatatttgttacaatcgattaacctacattgacacatcattatcacccaaggtctatagtttacattagggttcattcttccggttgtacattctatgggtttggacaaatgtgtaatgacacatagacacaccattattgtatcacacacagtagtttcattgccctaaaaaccctctgtgctctgcctgtccctccctgctaacacctggcaaccaccgatctttttcctgtctccatagtctagtcttacttttgcagaatcttatatagttgggattatagagtatattgccttttcaggcttctttcccttaataatatgcatttgagattcctctatgacttttcatggctgaatagctcgttttaattttattttttatttttgagacagagtctcactctgtcgcccaggctggagtgaagtggagtgatcttggctcactgtagcctctgccttcaggattcaaacgattctcatgtctcagcctcccgaatggctggggactgcaggcgtgcactgtcacaccaggctaaattttgtatttttagtagaaatggggttttcccatgttggccaggttagtctcaaactcatttcctcaagtgatacacctgcttcaacctccccaatgtgctgggattacaagcgtgagccacccaaccaggcctgtgctatttctaaaatgcaggagatgaagttgccatgtgaaagatgcaacattcttatcttcaaggatgagaagttgaaatgagagaattctatacagaccttgttaaaacactgttatcttttaagcctccccatataatttagttgcctcttcataacttattattatttgtccaattcagtgtataagtaacagactctaacttcttctttgggtcttcaaatgtccttatgagggttcccaacccatgtaaaacttgtactcaataaatttgtgggactgtgtggtggctcactcctgtgatcccagtgctttgggaggccgaggggggcttgcttgagtccaggagttcaagaccagtctgggcaatatagtgagatcccggttcaacactttttttttttaattagattggtgtggtgggtggcatgtacctgcagttccagctactcaggaggctgaggtgggaggatagcttgagcccaggagtttgaggctgcaatgagctgtgatctcaccactgcactccagcaccccttatttataaataaatataatggctagccttagggactctgttcgcaagattaaagaacagaaatcagatgtagaatagcatataaataaatttatgtgcttttcttctgttaacctgtcctatgtcaatttaattcttgggcccagctgagactctagggatggaagtggagttttgccacccctacagtttctggtgacaaggatgggatcctctcaagcctaaagatgggatcctgggagaacaaataaaagcgggcacaggtaggaattcttaccaaagtgaactctttttttttttttgagacggagtctcgctctgtagcccaggctggagtgcagtggcacgatctcggctcactgcaagctctgcctcctgggttcacgccattctcctgcctcagcctcacacgtagctgggactacaggcacccgccaccacgcccggctaatttttttttgtatttttggtagagacggggtttcaccgtgttagccaggatggtctcaatctcctgacctcgtgatccgcctgcctcggcctcccaaagtgctgggattacaggcatgagccactgcgcccagcccaaagtgaactcttctggatctctgtctgtaatgcctggttgaaagaggagagtaaaatttttccttgtccctttctaaattcaaactggcaggagaaaagcatggtaagaattgattctttgagttatgactcttatgtcaaccttaaataatgagattcagaaaatatcagctaggcacgttggcttatgcttgtaatcccagcactttgggaggccaaggtggaaggatcacttgaacccaggagttggaggctgcagtgagctataattacatcactgcattccagtctgggtgacacagacctagtctccaaaaaacaaaaacaaaaaaaaccaaaggaaatatgatttttattctagtgcaaagcttgaggatggacacccaggaaacagcttccaaagggttggggtcattgctccaaagtggggaagctaaggtttcactcatagaggcagaaacagtgtcagcaggattgcaacatcttctgtacaaatccagtatgttagattccattagtacagcttgctacattccaaggaaaattgtttcaacattctgtgagaagaagtcaagctctgaggtcatcttatctctgatgctgctcagacatttctaaccatttacagggaaaagcagaagttgcaactgcatgctccatgcctcaggccacatggccacattcctcctgaggctcataataatgtaaagttccaacagcttggtggtggctcacgcctgtaatcccagcactttgggaagctgaggtggctggataacttaagaaaggagtttgagaccagcctggccaacacagcgaaaccccgtctctactaagtatacaaaaattagcccggcatggtggcgggcacctgtagtcccagctactcaggaggctgaggtgggaggattgcatgatcctgggagtttgaggctgtagtgagccatgattgcagcactgcactccagcctgggtgacagagggagaccttgtctcaaaaaaaaaaaaaaaagaattatttgatttcacacttccgaatttggtatttggctctgcatacatagtggctattgacccacagcctcccagaaataaggcttgttttccatgtctctgttgtgtggtttatcatatcttgttttatgtcttgagaacatggctctgtgaccaattgaaatattctctttggtttctgccagctgcaggggttgggaggacaagtccttgttaggctgctagccagctgcccaggaatcagaaacacagtgtctctgtccaacggttccagctctcagaggagtttgtcctacttgtctcagctttcattgccttgataacaattaggatatttgcctgcttaggctatcttgaaaaagactttggatcttgagggggattgtatcttttccagcctgtttgggatgctcttctgtgcctccagttaagccagaaaaggcatactgattttaagccataaaaaggcttattggttttgagtcacaattaaagtaggtataacattgaagatttggacttttgaatctaaaagctttttttttttttttttttaagacagagttccgctctgttgcccaagctggagtgcagtggtgcagtcttggctcactgcaacctctgtttcgtggattcaagtgattctcctgcctcagcctcccgagtagctggtattacaggcatctgccaccatgcctggctaattttttgtatttttagtagagacggggtttcaccatgttggccaggctggtatcgaactcctgacctcatgatctgcctgcctcagcttcccaaagtgctgggattacaggcatgagccactgtgcccagcctaaaagtatttttattaaagcgtgctattggccaggtgtggtggctcacacctgtaatctcaaccttgtgggagactgaggtgggaggatcgcttgagcccaggaggttgagctgcagtgagctatgatcttgccactactgcactccagcctgggcaacacagtgagaccccatctgtaaaccgtccccccccacaaaaaagggtgctttcatcccaaacaaccgtcctattggtaactagagaaatatcaaattaaaaagaagacacaaagaaatataggccaggcacggtggctcatgcctgtaattccagcactttgggaggccaaggtgggtggatcatgagatcaagagatcgaagccatcctggccaaaatgttgaaaccccatctctactaaacatacaaaaattagccgggcgtggtggcgtgcgcttgtagtcccaactactcaggaggctgaggcaggagaatcacttgaacccaggaggctgagtttgcagtgagccgagatcatgccattgcactccagcctgggtgacagagccagactctatctcaaaaaaaaaaataaaataaaataaatatggttagctttagggacttcctttaatcttcctcaatattaaagaacagaaatcagatgtagaaaaaaagttgaaatctgcaccctctgtaaattatcctcctccacccacctgtgctctgctcaacccccaagtccctgtccctgatcccccagaaggtctttcggatatctgggcccctgacttacacttaccctcctcaaaacttggccctattctccttagcaaatttcttttagacctaaaacttctccaaatatcctttcaatgcccagctgcctactttaacttctcttttcctataaaattcacagaaagcaccccagcctgttttccaggcccaagatatacaggtgacatgtatatactgatagccagaaaatagacctaacacaggctctgggaatgagcagccaggcttgcttcactgtaccttacaattcctcctacttcctggggctctgtaatcaaatctcatcagctccaggcattcccatgtttaggccgaaaccacaaaaaagtctactggactatcgtactcttaggaaaaagaaaccataaaaattaccctagatctctgataacaaaaaatatgctctgaaactccttggagaaaatctacattctttctcagttttcttgctctgtcgccagtcttatcatatctttaaaacttaagggccaggcacagtggctcaagcctgtaatcccagcactttgggaggctgaggcaggcggatcacgaggtcaggagatcgagaccatcctggctaacacggtgaaaccccgtctctactaaaaatacaaaaaaattagccaggtgtggcggcgtgcgcctgtagtcccatctgctgggaaggctgagacagcagaatggcgtgaatccgggaggcggagcttgcagtgagccgagatcgcgccactgcactccaacctgggtgacagagcaagactctgtctcaaaaaaaacaaaaaacaaaaaacaaaaaacacaaacttaagtatctgaggaactgggctgggcacagtagctcacgcctgtaatcctagcactttgggaggtcaaggtgcgcagatcgcttgaggtcaggagtttgaaaccagcttggccaacatggtgaaaccctgtctctactaaaaatatatatatataaaaattatccatctgctggggaggctgagacagcagaatggcgtgaacccgggaggcggagcttgcagtgagccgagattgcaccactgcactccagcctgggtgacaggacaagacaccatctcaaaaaaaaaacaaaaacaaaaacaaaaaaaaacttaagtatctgaggaattggctgggtgcagtggctcatgcctgtaatcctagcactttgggaggtcaaggtgggcggatcgcttgaggtcaggagttcgaaaccagcctggccaacatgatgaaaccctgtctctatgaaaaatatatattaaaaaagttagccaggtgtggtggcatgcacctgtaatcccagctacttgggaggctgaggcaggagagaattactggaaccactcgggaggcggaggttgcagtgagctgagatcatgccattgcactccggcctgtacaacagagccaggctccatctcaaaaaaataaaataaaataaaataaaagaatctgaggaattaactagaacaacccccagtatgctagtctgagattaaaaaaagtgttgaatgtttaacattttaggtgctttacttcaataatgtttgatatttgcctaatatatatgtcataaaaattgccagcaaaataaaacttaagataataactagctttgtctaatgtttcatgaagttttcacaattcagatataattgttaaataaactaaacttatataaatgcaagtgggaaaaaatttgtaaataagttattattattattttttgagactgggtgttgctccattgcccaggctaaagtatagtagtgggactgtagctcactgcagccttgaactcctcttgccccagtatcctgagtagctggggcaatgcctggcaaatttttagaaaaattttcttgtagagtggagtcttgctatgttgcccaggctggtctcaaattctgggcctcaagcaacctcctgtcctggcctcccaaagtgctgggattacaggtgggagccactgtgcccagctataaataattttttactgttttaatttttatttttgactgactcattgctagccagagctcgggtttctgtcacccacagcctgggaggccttaagtaagtgattcaacctcactgagcctcactctttgcctctgaaatggggatcacaggaattcctgccaggcaggggatatgtgaagactgaacgaaatgattcacacaaagatgtagcccagtgcctgggggacactaagcacatgctgagccttcagccacctgggaaggataaagggaaacacgggtggccacctggggctgatggaggaatgaggggcccgctgggagtatcctgggcaaactcacctctgggcatctgccctgatcttgggctggcgtcacaaggaagttggtcaccaagaagaacacgttctctccctaggaggcaagtctcaaagttggcctggctgggcttgcattgactggaaaggccagaagccggcagcctggtttatgagggaagggatgttggccccatgaaatcattaaccctgtccccacgtaaggcagattgaagcagagatgggaggctggcagcagttctggccatttctgagaccatgaagcctcatgcccatgtccatctcttgagacaagtttctttctcatttgttcaaccaaaatatcttttattttctttcttctttatttttttttttgagacagagtctcactgtcacccagactggagtgcagtggcatgaactcggttcactgcaacctctgcctcctgggttcaaaggattctcctgcctcagcctcctgagtagctgggattacaggcgcacagagtttcactttactcgtccaggctggagtgcagtggtgtcatcaacccttactgcatcctgtaactcctgggctcaagagatcttcctgcctcagcctcccaagtagctgggactataggctgtaactaccatgcctggcgtcaaccagaatattacgacagcctgctgcttctagtactgaagatccaggggagagctgggccctgcacctgccaggatggagtggaggtgagtctcccatcccacacacagcagcactggcatggcagggcacaggtgagaagacagaaagctctgcctgtggtcaaagggtggccaaggatgttggaaggggaggctgaccctccagtgctgcccatgagaacactgaatttggggaatgcatgcccaggaacggaaggtgagggctgtgcagagggtgctgagagtggcagccattgggattaggagggatgggtggccactatcattggcggggggcctcctgagggtagaaacaggggctgcaggctctcatgatgcctggtgtgaaagttcagcttggctgctgtgtggtgtgcaccaagcagtagggaggaggcgagaggggcatctaagggccttctaggaggccatagtctcatgcaggcatggcatgggcagtagtgaaaaatgttggaagggacaggaaggggttgaggctgagtcatgggtctggctgaggcactagtggatgtcacagccatcatgactagtggatgtcacagaggccatgccaggagagggaaataattgatctttggacatatgagtgtgcacctggaagacagctgtgctctgggcaggtgttcactggggctacatacaccctgggaatcagaggagcagaggtgggtggaagttaaggctgtggataagctgggtggagggaagaggaaaatgcagctgagaagggtggaggaggagcacctgaccgaggtgccccaggtcagggagcagggctacaggaagttccacgccctggccccaccacacccctcccacaccactctcaagctcaagccattagtctcaaacactcccttcttttctgttggcagccttcggaaatgcagtttctctggcctggtttctcaacccatccctttttctaccagaaacctcctacacatccctgaaagtcctgttcaggtgccactcctctgtgaagcccttcctgagaacctgcagccacctttggcatcacatgcttctctctcgcacacactggctgcatggcgggtgttcaagctgtcagtggggaaaggacttgcgcccccgtcagcaacatcagggcccccacctgaggtggcttcacgaagtcggccacatcccacagccggtttccaagctccttgatctgagtcacggaaacccctttgagtttggttgtgatggaaatctggggttccaggtcccgctcctggtagccttttttggcgaggagcgcccacctgggaaggagaagatgggcagtgtggtgtccccccagcgtgtagtgacggggcagagctgggccctacatgctcagttctctccccacaccctacaggctcccagtccagcatcctctctggccccacttcccactgtagactccctgaacgagacagaagctccagccatgcatcagagagccagtgccctcagacaatcaccttcactagccagcacccacccccagcctcagtagacccagctccgagcttatagactcccctgaccggagatatagctggtggtctctctgggggcctagtgctccagctctcacagatgttaaggacaatgtcttgtgccccctgggtggggccgtggggagggactgggaagcaggcaggtggacacacaggacaaacacacagcttgttcttgctctcctgtcttgtattgcctacctcccaccccgtcccattatggccccttcccctccagcccctaaacagcccaaccctcaacttcaacccagcaggaccaagccccacccccgacctcttcccttgcccctccagcctggccaaaagctcttctctcttaccctaccacatagacgacgatcccaaactgcagcagcctctgcagggcgcccccccaccagttcctggtcatcacatacttctccgttttataatccagaagcccctagtctgctgtggcccctggggagcccatgctgccagctcctgctagctgcgggcacatgagtcagcatggcagctgcagccgcagctgaacaggaggcaaagcagggcccgagccaggccacgccagccgctgttaaagggacacttccactaaagcaggatccagcctccaacacccagccttcagcccctaaccccagctgccctgcacctcccaccctccctacattctctttgctgggccctggtggcacacagaaaacagcagctctgtccctgccctctggcctcacttcctccggtgggagtggacgtggtgagaggatggggaaggacagctgttatcagtgctgtgagaagacggcctgagggcagcaacagccccgggggggctctgagtaaagcttcaggaataagtgacttctgagctgacgcttgcagattctgaagttcaacaagcagacaaagatggggatggaggttcccaggggagcgaacagcgtatgcaaaggccagcgcatgcaagagaactgagagccacagagtgagagggtgacctggctctgcgaagttccccaggccctcctgaaaagccattcccaagtgcagtgaagaaaacacaagctctggagtcaggcatgtttcccattccatgaaaggggggcgatgctggaaccgcctaggggaggcagggggataaacgcagcaaggcgcccaatccggtgcatggtctgtggcgcatgcagtgtatcagcccgggcgaggagcctcagcacaagccggccacagtttctacggcaaccgacaacaccgggttgccggggcgaccgccgcgggagagcgcgtcgctattggctgtggggggtgcctgttgctggacggcacattcggttggtcagcgcagccgcagactccgcccacaatcccgggccgcgctctgggcgcggggtcaagctgtctccgactcagtgtctgagactgcgagagggtcgtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggtgctcgggggagggggcaggcccgactcctcccctttgggggtcttctcccgcaggggttgggggaggcgggctggggctaaggccagcagggaacgtacccgcctgcggggcgcctccagccccctgccttcccttcattgctcctggaagcatcaggataaaatgcaaaatcccgccagacagtgcaccaagggctgtcccaccctgaaatgaaatcagagccgggttttcccaatccacaggaaaaactaagctaatggatgtatggaatttagaactatctcggttttttctcccgtaaaatgtttacaaaacatttgtggcctgcaatccaggttaaaagacacagcatgcaatttggcatcagacaggcagaggcctgactctggcaggattagctaccaccactagctgtgggatgctcagcgcaggccagccatgacttctactacaaacaacattgggttgcttgggctcatatttattaataaataaatatataaataaattatttatttattagagccagggtcttgctctgtcacccgggcgtcagtgcagtggcaggataatagctcactgcagccttgaactctgcactctagtgagccttctgcctcagcctcctgagtagctgggactacaggagaccaccacgtctggctaatataaaaattttttggctgggtggggtggctcacgcctgtaatcacagcactttgggaggcccaggcaggcagatcacctgaggtcaggagttcgagaccagcctggccaacatggtgaaaccccgtctctactgaaaatacaaaaaactagcccagtgtggtggtgggcgcctgtaatcccagctactcgggaggctgaggcaggagaattgcttgaacctgggaggcagaggtttcagtgagccgagatcgtgccactgcattccagcctgggtgacagagcaagagtctgtctcgaaaaaaaaaaaaagaaaatttgtctagctatgttgcccaggttgtccagctttcttttgatagccgtatgactttaaggaaaagatttgcgttgcctgaggcttgatgtcctcatctgtcatatgggagcagtggtcccaagaagcacaggaagcagtgcttctagaggcaaaacataggccaggtagtgacacagggcaggggaggacacaggtggctgtagctgtgcagggtccacattcgtccccctgtctcctgccaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccaggtaccactggagggacactgtatccaggcttacggggagaggcctcgggagacagcagccatgggagtgcccctgtgtctgtcccctacactccccagcttctgcctgtgtcagtcatgccctaccctccacatctgggagacagatgggattgaggctgtgacaggtggcgttaagggttgtggatcctgcaggctcctaacccgctggggggtcagggagagctgggggtggggggagaccttcacagagcctaaaaggagaagcaggtgtcacttaaaacaggtgggaaggggagggctttccagctggaggatgtggagtgggctgagccctggagcatgagccaggatagtggccagtgtgtttgctctgtctgtcccagggcgcccgggctctggcttcctcattgagctccaatccatatgtcaagcggctggaccttcgagacaatgggctctgtggggcaggtgcagaggccctggcaggtgccctgagcaaaagcagcagcatccatggtaggtgctgggtctggggcaggtgggcaggcgtgtcctccttttcctcagggatgtgcctccatcgttgaaagctgggccgtgtcacctggggcctgctggtgttgctggtggatagaagaggggcctcatcacaggagggggcatgtggggtggagttagaccctctgctgtgcagccgatgcctgatagaagtcctttcctcacccaccccacaccatcactcccctcccttgctggccagcatccccctcttcacctagcacatgggagactcccagtacctgaatgcaggatgggagagtccttccacacagagaggtgggagttgggcattgtaagaagcaggtaggcaatgtgggagtttgatggggctggatccaaatgccagttctgccactgaagagctggatacctgggcaagcagcttaacctctctgagcttcagtttctgatctgtgaaatggcccccaaaataccttatgggcttggggctgtggtgagcatgaagtgaaatgcactcctgaagtggtcagaagagtgtgtgacccatgtacgtgctccatgcatggccacttgggctattattgccaatcctggcaacggggctgtgagggcttctgaagtgggtggtgatatcactgccagatgcagccatcgacggtatagctgccccccaccacagcagtctctacagtaccaggaggtaggcggttttaaccacttgacacagaagctggtgggcacacagggagggggaggtcaggggcagaggggacccagccattgggagccagagccaccatgcaaccccaggacagttaacctgtaagtccccttcctcagcctcagacctggaggtttgggggatggcagaagtaggggagtgcctggctttgcatcccactggccgaggagtggttctgtcccccagatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggtaacgcctgcgcagggcaccatggccatgaaagctcagcttcctggggcagggatgggtgggggttggcaggaccgcgctgcacatcgccagggagcatgtgctctggttcctgctccccacaccccaccttgccccactcctcttccactccagccacacggaactcttcattccttccacaaatatctcattgcgcgctgctgtatgtgctgggcactgacttagccaccagggatccaccttgaacaaaaccaagttcctgacctcaagggacaatgttaacaacatcattctgagtaattattggtgctacaaaagaaacaaatagtttatgattctagagaagaacagggaccccctactttaaagaggtggctggggaggcctctgtgaggtgacatttaagctgaaatgtgcagggtgggaaggagtcagccatggcaagatcagagggagagcattgcaagcagaggaatagtgagcatgcgggcctgtttcccagactggcggacagcagtgtgcctaggctagggagccagggaagcgtggccaggctgtggggtggagagggcagagggggctgcagggctgtaggccgtggcaaaaacggtgaagattttgtttcaagtgaggtagcggatgtgattgggattccttgatctcatcactgtcatgcccctgagcatattcaggagctgtctgctttgccaggaatttgcacttctacctgcctctcctcaaatggtccaataatggtaaggatcacctgagaccctgggttaggcatgcagatgctgaccctggacctgctgaaccaaactcttaggggaatgctggtgaatctgtattttaatggttgccccaggagaatcgtctttttattttttattttttgagacagagtctcgctctgtcacccaggctggagtgcaatggtgtgatctctgctcactgcagcctctgcctcccaggtccaagcaattctcctgcctcagcctcctgagtagctgggattacaggtgcgtgcgacaaggcctggctaatttttctatttttagtagagatggggtttcaccgtgttggtcaggctggtctcgaactcctgaccttgtgatccgcccgccttggcctcccaaagtgctgcgattacaggtgtgggccaccgcgcctggccgagaattgtttttcagaagcactcctctgtctccagctgcttagagcaagtggggtgacatcagccttggcctgtgagaattgcctctggcatataactgccagagaaccagtttgccttctaagaaaattattgcaagaagtcagtgaaattaagtgaggtggccgggcccggtggctcacgcctgtaatcccagcactttgggaggccaaggcaggtggatcatgaggtcaggagatcgagaccatcctggataacacggtgaaatgccgtctctactaaaaatacaaaaaattagccgagtgtggtggcaggcgcctgtagtcccagctacatgggaggctgaggcaggagaatggcatgaacccaggaggcggagcttgcagtgagccgagatagcaccactgcagtccggcctgggcgaaagagcgagactctgtctcaaaaaaaaaaaaaaaaaaaaaaaagtgagacttggcaaggcactgtgcctatctgtaatgccaacaccacttcgggaggctgaggggcgaagattgcttgaggccaggagttagaaaccaaactgggcaacatagggagccccagtggtgacaacaaatgattaaaaaaattagccccgggcaacagagcgagactccgtctcaaaaaaaaaaaaaaaaaaaaaaaaaattagccccaagtggtgacatgtgcctgtagtctcagtcaggaggctgaggtgggagaattgcttgagcccaagatgtcaaggctgcagtgagccgtgattgtcccactgcactccgggttgggcaacagggtgagaccgtgtcttaacaacaacaaaaaatactttctttcctctttagtgcctgtttccctgttatgatgttaaaagcaggtactgtgatgtgcagctggtttctggctcttctgcaggcgctttcttgtgtgtataaatgttcgctttggtgttcctgtgagggttgtaggatgaccgctggagggttctgttcggccatgttgctccgccttcatctctaggtctcgctattttgcccaggctggtcttgaactcctggcgccaagaaatccttctgcctcagcctcctgagtcgctgggaccacaggctcacaccactgcctggctttcaccttcctttctctaccacccccatctcctctctaccacagctgtgccagccctgttgcctcttgcctagcctatggcaccagccttccatctggtcccccagcctcttgcctctgcccccacccagcccagtctatcctggacacctgccacttgctgaaatgctaatccagcctcatcacttcctaaggccctccctgactccttgccacttgtatgtgctgcctaagccccttggcttggcacacaaggcccctcagcatctctcaagtgcccattactccttcctcacctcactggcttccccctccccaggcccagctccaagcctgcgtgcatttccacaggtgcctctgccatttgcagtttcctgtgtctcctccccactgtgcataagcctgtgtgcatttccacaggtgcccctgccatttgcagtttcctgtgtctcctccccactgtgcatgcacacacccctggggaattcctcagtcctgagttatctcctctgtcctctttcctgacttcccccaagacaggctggccaccactctgttctcacgcctcccccttttagtctaaatgaatagctcacatcccatacatttgcatttgtatctcccccatgaaatgtgagttccttaagggcaccgcaggcccacattagtttcatgtctgtgaccctcctgcccagcagaggctcggcacgcagtgggcatcagtgtgatcttttgaaggagtgaagagagtgagtcagaaggtctctcttggtgtttctgaaggggagacacttggaccagccctggcagaaaacacaggactcaccgagcttaacgtgagctggaatcacctccggggcccaggagctgtggcatttgccaggggactggaggtatgaagcccccacctagtcggccctacagcctgtctgctggggcctgtctcccaggggccacctccctgtctctgcagctcctcggaaatgaaccttggatcttttaagcacagcttaaagactgtttctttaggtgattttaattttcctggcttcacttagtgaccacaatacactgtgctcaccgtcacatactttcctgaagggtcactgttgaatatcttgcaccttccccagacaccatagacacccagctgggaagggacatctgtgcagtctggtgacacatgctcactgttgggcatacgcaggtggtttcctgagatgacaccttgcacccttggatgccagcacagcctctcaaacacccacctgttcccttccatgttgtggttcatagggctcgggaatgggtggctcaagctggtgctagggtggtacaaggtgtctgcaatgtccccagtgccagataccctgtggggccctcctcaggccatggcagctgctgtcttgccctgatgcaggggctgaccttggggtcctgccccacaagatggcatgtcacactctgtcttgccagagcacctacccttctccccatcacagtacgctggacaggtttcatccaacagctgttcactggatcttgggatccctgccctctagagccattaagtgggtgtggagtccgatcaatgtttctggggcctgctgctgctctgcacacgcccctcccagtctctctgagggccattcacgtctacaccggtcctttcctgttgtgctctgggccactgggctctgttgaccaccatcatccaagctgcagccaccagggggtctgcatggcactttcctgacccttccttggagcctctccccttctgccctttatctcttatctttgcacctcagggctcctggtctctgaggctgtggcaccctggcttgctccactgtcagatggggtcccatgacttcactctttggtattctaggcaaacatcttccttaaagttctagacatctcatacaatggctttggggatcctggagcctctgcggtgggtgaggctctgaaggccaacaacgtgttggaggaactcaacatgaggtgaggatccccggggggacaccccaggaatcatgggctccatgatcttgctgctgaagcacacagtctacccgtgatggggattcccgtgatggggcttgagccacaatcccagagcagctctgtcatccttatcactggagtttataattttatttatttatttaaaacagcatcttgctttattgcccagggtagagtgcagtgctgtgatcatggcccactgcagccttggccttcccagctcaagcaatcccaccacctcagcctcccaagtagctgggactacaggagtatgtcaccaagcctggctaattttttcttttttgtagagacagtctcctgctggccttgaactcttgggctgaagcagtcttcctgcctcagcctcccaaagtgctggaattacagtcatggggagttcatcgttgttacatagagacctgtgattcctatagcacaggcggatggctgcgaattgcacacggtgtataaagcatctccggcagagcctggtgcatggtgggtgctccatgcaagctttcctcccttgcagaagacgagccagggccaggttctgtggctcacaactgtaatcttagcacctaggaaggctgaggcgggaggatccattaaggacaggattttgagaccaggctaggcaatatagcatgactccatctctatgcgaaatctaaaaattgtccatttccggtggcatacacctatcattcctggtacttgggaggctgaggcaggaagattgcttgagccgaggattcaggatttcaggctgcattgcaacagagcgagtaaaacgagcctagtctgggtggggcaaggcaggaccctgacaagtgggccccagtgcctgttttgctcagcatgtggctactggagcatgccctgtgtgaggggctcctccaggccaggcagcgtcccagcctagccaggaggcacaagcccagagggaagaaaagaggcggatgccagggaggtcacgggccagaggccagggaggtcatgggctgctgtggctgagaccctccccaggggcagctccctgtgggcaagaaggccccactcaatcctgcccagctttcctccccatgggaggagctaagactggaggcagccgcggaggctgaatacggaggtgcagccagagctggggtctgagaagtcagagagaagcgggactgactccggagacaaagtggtccagggcggtgctgaggactggagtttgggaacggcaggaggaggagaggccttgaacataagctaggtgattttctggaacaggcgttgtaatggtgataggcatgaggtgtcagctggggcagaatatgtgggagcacttgcagagctcagaggagcggcagctggtgtccaccaggacagggacgctttaggtgtgtttgccgtgtgattcctctgaacggtgtcatctccaccttttacctgttgatctgtccagggttcctggggtgtgagtggagggaacaagagacccaacctggtggctgcaatggcagctccagtgggcaccctggggcagtgggctctgcaccgctgcttggaaggttgcacaatgcatgtgcctgttgtttttgttgcagtaacaaccgcatctctgcgatgggagccctgagcctgggcctgggcctccgggtcaaccagacgctgaggattcttgtagtgagtgctagcctgatgactgagacaccagcacagacctgccctgtaacagtccacacagatccctcccccacagcccccacccaggggcagcaggcaggtgcacacaggctggctcactcccttgccactcaccctgaatctggggcctggccctcctcttctccccttcatccctcccagcctctctcccacatcttcttgctgcccttcctcctctgtgggctggggtgctgctctgctgaaggtggctgggcaccccttgtgtctccctcatcttctcccctgcctttcctctggccttgctgagacccaggccccacccaggtgttctgttggccactgctcaggcccacctgaggcctggtgttcccagctggggttccttcccctgggtttgcaggtggggagggagtgctgagcaggacagggagcagaagacagacacaggagggaggcaagccgggagcaggtccccaggggaccactgtgcccacagcaggtacgtgctgggggacagtattgccagctgggtatggacatccagctctgtcggccctcagctccccaccctagccttactgggcttctcccatagctctcctcccctgcttcctgcctcacaggaacctggacctctctgaagcatagacctgcgtttcgagtcacctcgtagacagtcctctaaatgtcccaaagacacgtgggaatgtgagagtccaacctgaacgcatacccccctctaagggccacctcctggtggggggctccttcttccttcttcccaagtcaccagctggggcccagagcctgcctgcccctcccttttccacaccctccctcccaccttctgcaggggctcaccctgctgactcctccctcttctgacttcctctcttagcttctgtgaacttgcgggattcctggctgcggttctttcttcccagctgctacccaggaccagaaacatgccctgctttaaaactgttggagttttatcccctctggataaacccaagctttgagtgcatcatgtcatgcggagctaggtgtggtggctcacgccaataatcccagcacttcgggaggctgaggcaggcagatcgcttgaggtcaggagtttgagcccagactgaccaacatggtgaaaccctgtctctactgaaaacaaaaagatgagccagatgtggtgatgcacacctataatcccagctactctggaggctgaggcaggaggatcctttgaacccaggaggtgaaggttgcagtgagctgagatctcaccactgcactccagtctggatgacagagcaagactctgtctcaaaaaaaaaaaaaaagtaacatagcatgtcatgggggatctgggctctgccagcccctctcttccaagttcagtgctctcaccccaagcttggagcacacacacacacacacacacacacacacacacacacacacacacggtactatttttcacccctgcctttgttcctctgctgttcttgctgaagtgtccagctccggccacctcacctgggaagctccgctgagccctgcccagatacacctcccctcccagcctttccctcccaggggagctggtgcacactcactcactgcgctgatcacaccacatttcatgatgcttcctttccctcccctctccccagcaggcaagttcttaaaggcaagggtgtgtcttgtgtgtctatatcaatcggaggcctctcccttcctttcttccctgacccagcagcctcaccagagcattctgtctgactatctgatggagacaccttctgagccgaaacagtgtggccatagtggctgtgtcctcagagatgaggagcccctccttccctttcacattgctctctggccttcccggacctggcttctcgcagctttgtgtgcgtgtttctcaggtgtccaggaatcccatgcgaagtgaaggctgctttggtctcctcaagtctgtccaggacaatccagcctctgccctggaactgctggatttctcagtaagagcattttataaacctcgtttctgatcctcccagcagccctgtgaggtatcataattttagaagaagaaagtgagggttacagaaatcaagagccctgcccagttacacagcgtggcagaagcagagttgcaacgggacttgaatgcaggcatggggccactcagctctgcccgctccagactgctggttccacgggatctcacctggggcacctgcctgggttcttcattggctgagagaggataagtggaggtctgggcatgatgctccctatccactgaggtttcgatctgcaggcgcagcacctgcaaggctgccctctgcccctcccctgactgtctgcaggtggactgtggtgctggaagcttcacttgagtggctgtgagagagattaggatcccttttcattcaattttgccactttttttttgagtcagggtctcactctgtcacccagttgcagtgcagtggtgtgatcgtagctcactgcagtctcaaattccttggctcaagtggttctcctgtctaagctccccaagcagctggaagtacaggtacaggtcaccatacctggctaaagtttttagagatgggggcttgctatgttgcccaggctggttgcaaacttctgacctcaagtgatcctgtgccatggtctctcatgtcttgggtcaattttgattttttttttttttttgagacagagtctcactctgtcgcccaggctggagtgcagtggtgctatattggctctctgcaacttccggctcccagattcaggcaattcttctacctcagcctcctgagtagccaggattacagatgtgtgccaccacgcccggctgattttttttttttttttggtattttttttagtagagatggggtttcaccaggttggccaggctggtctcgaactcctgacctcaggtgatccacccacctcggccttccaagtgctgggattacaggcatgatccattgcgcctggcgaattttgatttttttaatgtagaaaaagtgccaggtgagatggctcacacctataatcttagcatgttgggaggctgaggtgggaggatcccttgaagcctagagttcaagaccatcctgggcaacacagaaaggtccccatctctacaaaaagctttttaaaaaattagccaggcatgtggcacatacccgtagtttcgggtactcagaagactgaagcaggaggatcacctgatcccaggagtttgtggcttcagtgagctatgattgtgccactgcactccaacctggggaacagggccagattctgtctcaaaaaaaaagggaaggaaacaaaaaaaattgagttacaaatcagtgctgattctaaccctgatttttttcaacccagacttgagtcaaagcctttccagaaatgtgtctgtgtagtttcaattcttcaggtttgggacaaccgatgtcaaacgtccttaccatttccttctaatggcctgttcttgccttaaccatgtgcctgctgctctgagaattcctgtcagcactggatctgtcattctaaaagaaatagaatgtcatatggcattatcctgcctgaatatacacttacttgtcacaatgtatggtcattatcagaagcccctagtcttgtgggaatgccatgggctttggaatcagttcagggttgggaccaaatcctgtgtctatcaatgtgagatcctggacaagattctgagtcaaagaatcataaacgatcaatcaataacaagcctgggatgggcatgatggttcacgcctataaccccaggacctcgggaggccaaggcaggtggatcacctgaggtcaggagttcgagaccaccctggccaacatggcaaaacctgtctttactaataatacaaaaatttggccggagttggtagctcatgcctgtaatcccagaactttgggaggccgaggcaggcagatcacctgaggtcaggagttcgagatcagtctggccaacatggtgaaaccctgtctctactaaaaatacaaaaattagccgggcatagtggtatgcacttgtaatcccagctactcaggaggctgaggcaggagaatcacctccaggagaacccagaggcagaggttgcagtgagccgagatcgtgccattgcactccagcctgagcaacaagagtgaaactctgtgttgtaaaagatagaagaaaaattagctggatgtggtggtgctcacctgtaacctcagctactcgggaggctgaggcaggagaatcgcttgaaccagaaagcggaggtttcagtgagccgagaccatgccaatgcattccagcctgggtgacagagcgagactctacctcaaaaaaacccaaaaaacaaaaaaacaaagaaaaacaattagcctgaattgaatattctatcttctattccttaactgttgttatctgttatcactagtataatctgactagcccagattttattctgagctttgagggaaatagttttgaagacttatagttcaaggaaaatctttccctaggctcagacttgtgtttttgtgaaatggggctaacgtctaccccgcaaggccatcatgaacataagctgagatgacagacctaagggaaaggccttgcacagagaaggactccatcagtgccagttctgttcttcacaaccccttggttttttgtttttaattgaggaacaacatctatgctgaaaaatgcacaaagattaagcatagagcttggagaattttcacaaacagcataggtgtctatgtaaccagcccccagatctggaaatacagcatagccgggcatggtggtgggcacctgtagtccctgctattctggaggcttaagcaagaggatagatagcttgagtccaggagctcagggatgaagtgagctatgattgagccactgcactccagcctggtgacacagtacgatcccatttctaaataaataaatacagcaggcctctaaacatcccccattgtccccttctctcctggatcttactagtttgcgggtatgagactgtcatccacaggggagaagctgcccgaaggagcttctctgagaccttgcgtgtgtgagtgaaaaatggtgaagttctcagatagtaacaaagttcatccttgtaatgggtgtctccttaggatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtgaggagctctttgactcacgaggccttgttaccacttgtgtctgcactgagtcctcacgtcagccgtgtgctaagtccacacggtgctcacacacctgtaccctcctctgtgccccacggaccctgcactcatctgggccttcatgtgctctcactcattcctgtcacacaaacccctactaagtactgcacattgaactgggcatggtatccaagatgcccaagcaagtccctgccctccccatgttcatgttctggtgacctcaggaaactattaaaatgtaaggaggggtgcacactctacttttgagaatgcaaacgggcacagcctttttggaaggcagtttatcatcatgcactgagagcctcaaaactgcctgtgccctttgatacaatcatttgactaatgtgctctagagaaataaccagagatgtataaaagattgatgcctaaagatgctcatggggccggacgcggtggctcacacttgtaatcccagcccttttggaggcctaggtgggtggatcccttgaggtcaggagtttgagaccagcttgacaaacatggtgaaaccccagctgtactaaaaatacaaaattagccaggcatgatggcgcacacctgtaatccccgctactcaggaggctgaggcaggagaattgcttgaatcctggaggtggaggctgcagttctcaccattgcactctagcctgggcaacaagagcaaaactctgtctcaaaaaaaaaaaagatgcccatggaaatgctgtttatcataatgaaaattggaagtgtccccaataacgggattggccaattaaaatttggatatgttaaatgttaaaagccacatgctcaaagaacacttaaccattcatgaaaatacacatgattaatgttcagtgagaaaattgggaagaaaaaaatcacatggcagctgggtgcagtggcacgtgcctgtagccccagccattcagaggctgaggtaggaggattgcttgagctcaggagttggagaccagctggggcaatacaataagaccctgtctttaaaaatcaatcagtcaatcacatggcttgtctgacagttcctcaaaagcttaatcatagaattaccgtataacccattatttccattcctaggtatatacttgaaagaaatgaagacatatgtccccacaagaactcgtgcatgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtatgcaaatctatacagacagaaagtagattatacattgcctaggtgcagagaaatggaagtattggaggttgacggctaaaggatgtggatttctttggggggtgataaaagtgttctaaaattgattgtggtgatgtgcgactctatgaatacgctaaaaaccgctcgattgtacattttaaatgggtgatttatgcggtatgtgaaatacatctcaagaaagctgctgcaaaaaatatcatacgggttgagcctagtggtattaaaaaagtataaatatggccaggcgcggtggctcacgcccataatcccagcactttgggaggccgaggcgggcggatcacgaggtcaggagatcgagaccatcctggctaacatggtgaaaccccgtctctaccaaaaatacaaaaattagccgggtgtggtggtgggcggctataatcccagccactcgggaggctgaggcaagagagttacttgaacacagaaggtggaggttgcagtgagccaagctcacttcactgcactccagtctgggtgacagagcaagactcggtctcaaaaaaaaaaaaaaaaaaaaaaaggaagaatcaggctcagcgcactggcacatgcttataatcccagaaatttgggaggccaagatgggaggatcacttgaagccaggagttccagaccagcctgggcagcatcgtgagacccccgtttctacaaaaaacatttaaaaattagctgggcatggtggcatgtgcctgtcgttccagctacctgggatgctgaggtgggaggatcactcaaacctgggagtttgaagctgcagtgagccatgattgcaccactgcactccagtctggttgagagagtgggaacctgtctcgaaaaaaaaaaaaaaagaatggaaggatcaaactgggcatggtgatgcatgcttgcctgtaggcccagcctacaagggacgctgaggcaggaggatcatttgagcctgggaatttgagcccagcttgagcaacatagtgaaatcctgtctaaaaaagaaaaaaaggaagaatcaaataattgttccaaagtctttcaaaaggagtattgagtcccaactcggcactttcctgagcagggatatgtctcctctccttctcactaaggagccagaaactcaccccttctcactaaaaaagtgagaaaaataaaaatagctcagagaactttgagctatgtgaggcacgcagaatttatcaggtccggagacatgaatatgggacttcaggcagggcatgatggctcacgcctgtagactcaggaggccaaggtgagcccaaggtgggaggatcactttagtccaggagttttgagaccagcctgggcaacatcaggagatccttgtctcctcaaaaacttaaaaaaaaaaaaagctgggcatggtggcacacacctgtggtcctgagtcaggaggttgaggctgcagtgagctatgaccataccagtgcattccagcctgggtacacagcgagaccctgtctcaaaataataataacaataatatgctgggtgcagaggctcattcctgtaatcccagctctttgggaggctgaagtgggtgaatcacttgaggtcaggagttcgagactagcctggccaacatggtaaaaccctatcttttctaaaaatacaaaaattagccaggtatggtggtgcatgcctgtaatcccagctacttgggaggctgaggcaggagaatcgctggagcccgagaggtggaggttgcagtgagccgagatcatgccactgcactccagcctggatgacagagcaagactctgtctcaaaacaaaacaaaacaaaacaaaaaaataataattataataatgaaaagaaaaagaaatgaatatgggacttcagtaacatatttcttatccatgcccgggggcaattgtttaaaggcattttgttcctgactagcttaacccattatcttcctgtttctggaatttatgatacaaagaataatgtatagacaaccaatagcttatgtcgttttaatataaattcttgtggccagggaagctgaagtgataggattgtttgaggccaagagttgaagaccagcctcagtgagacccatctcaattttttaaaaaagagcaattcttggtaaaccacttaggaactgcctcttcttttctcttaaaaacagcatctctggccaggtgcaggggttcacacctgtaatcccagcactttgggaggctgaagcaggcaggtcgcctgagcccaggggtttgagaccaaccctgagaacatggtgaaaccctgtatctacaaaaaatacaaaaaattagctgggcaaggtggcacatgcctgtagtcccagctattcgggaggctgaggtgggaggatcacctgagcctgaggaggttcaaggctgcagtgagccatgatctcaccactgcactccagcctgggcaacagaatgagacgttgtctcaaaaaataaaataggctgggcacgacggctcacgcctgtaatcccaacactttgggaggccgaggcggtggatcacgaggtcaggagctcgagaccagcctgaccaacatggtgaaatgccgtctctactaaaaatataaaaattagccaggcatggtggcacgtgcctttcccagctactcaggagcctgaggcaggagaatcgcttgaacctgggaggcggaggttgcagtcagtcgagatcctgccactgcactccagcctgagctacagagcgagactccgtctcaaaaaaaaaaaacaaaaataaaaaaacaaaagaaaaacaaaatgaaaaacaaaataaataaaataaaataaaataaaaacagcattttgtaactgctgctaattaagagtgtatattcaaagcaacttgaatctccgctccagggctgaaggtcttaaatgtggcaataataaactttttttttttttaagagctctgtcactcaggctggaatgcagtggcacaatcacagctcactgtagctttgaactcctgggctccagcaatcctcccaccttggctttccaaaggaaaagggattacaggtgtcagccacctcactcagccttctcccttctatttaccttctcccttctattttagtttgttattctccccttttaagagcttcttccttataggtttaaccctgataggcagacacactttgttctcattctctttttttttttctgtcaccacagaatattttgcatgccatagagtttcaaactgtcttgaaatgaacgggttcacatttatgttctggttcacagagtgagtatctctatccacgtggggcaggcaggtgtccagataggcaacgcccgctgggaactgtactgccttgaacttgcaattcagcctgacggtcaaatgccaagtgacaaaaccatcggtggtggggatgactccttcaacatgttcttcagtgagattggggctggcaagcacgtgcccagagcagtgtttgtggacctggagcccactgtggttgataggtcctcgggcactggatggcagctttcctgggagagtgggagagcattggtaaaaccccacgtgcgctcctgtgaatccccctgcagaatggatgggatagacaagcaaatgcccatggcattgttagggcggaaactgaaagtttcatgtttagtgtatgtgagactcagctcctaatttaggatgtatgggaaaagctgctttgccagcagtaagatgggctgtggagagattcccctgtggctgcctcagccctgcacaggtggccctgcctgcagggtgtggggcattgattccctcctgaatgctgtgcactgtctcatgctggtgcatgaagagtcttgatgtgcatcttaggcgtagaaggtaagtacagaacatccatttccttcatccagattagaagtcccagatagtttccaaagagagctgcaaagagatagtacctttcagtgtcccccaggaggtgacaatgtcacctgaaagcacgtgggacccaggccacacaggttgatgggactgcccttcagaagtcacactgacctggtgactgtccagtttgtaagagatttttaacttacagcctttgatgtagtagctaagggtaggaaagatgtatgtacctgtagaattaccagtgctgggggacgatgcgagagcttatttcccttcactgggaactgtttatgctgacatttatttatgtatttatttatttatttatttatttatttatttatttatttagagaaagattcttgctctgttgcccaggctggagtgcagtggcacgatctcggctcactgcaacctccgcctcctgggttcacgccgtcctcctgcctcagcctcccaagtagctgggactacaggcgcccgccaccacgtccagctaattttgtttttgtatttttagtagagatgggttttcaccgtgttagccaggatggtctcgatctcctgacgtcatgatccgcccgccttggcctcccaaagtgctgggattacaggcgtgagccaccgcgcccggcctgtgctgacatttatacaagaactgactttaacttcctagggccttaaattgcatttgtgattggttatcacagagacattttctaccagacaccgccactgttgacctacaacatgtagctcatgtactttgaacagcatgtactttgtagaagtgaacagtcctggaacgtgttcaccttggtgtacagtaggccttaaagactcacagcacatgtggtctctttgtaggtgaagtgcacacagggacctacaggcagctcttccacccagagcagctgatcagtgggaaggaagatgcagccaataattactccagaggccattataccatcggcaaggagaccttgtcctggaccggatccacaaactggtaagaagagaaggcttcatgtggacgttgtcctgcacaggagaataggccttggatggtgaaaggaaggtcattttcgcagcacttagagcagcatcttgagtccgactaagtctgcaacgtcttactatgaagtatgcgtggtgatttgtgcatagatctgtattgtctgcttttctctgcttcaaagtgtgatgcgtgttcattatggatagtctgaatccgtagcaactctcagaggcaaagagaagtggccccggcttggtggaggttggtggtgtggctcccacgggcattggctcacattgtctggtttctctcaggctgatctgtgcatgggactgcagggcttccccatcttccacagctttgggggcggcaccgtctctgggttcatgtctctgctcatggagcggctctcggtggactacgggaagaagtccaagctggagtttgccatttgcccagccccccatgtctccatggctgtgatggagccctgcaactccatcctgaccacctacacgaccctggaacattctgactgtgccttcatggtcgacatgtcagtgcaacctggacatcgagtgtcccatgtacaccaacctcagtcgtctgattgggcagatcgtgtcctccatcacggcctccctgtgattcgttggggccctgaatgtgtacttgacagaattccaaaccaacctggtgccgtacacccacatccacctccccctggccacctatgccttgatcatctcagccgagaaggcctaccacgagcagctgtccgtggccgagatcgccagtgcccacttcgagccagccaatcagatggtcaagtgtgaccctcaccatggcaagtacatagcctgctgcatgttgtaccgaggggatgtggtcccgaaagatgtcagtggggccatcgccaccatcaagagcaagcgcaccatctagtttgcaggttggtgcccgactggattgaagggaggactgggtgatgtggagtccttgtgccatcaggaagcagcagatctgcagaataatgctgcccccaaaggcccgcatcctttgcggttgcttgtctggaaccgtcaccctgcccctgttccatgggctaggctcatgggcataaatcaatgaaccagagtgataattaattcagtggtgtcttttgaacttcctttgtgagtcatcacactatgtatctgtggtgaggtttttgtgtttttttaagaaaaaggtattttttggaggattttggtgccccttgcttggacagcagaatttgtgtggaaaagataggttgaacttagtagaaattttatgggcattttggggaatcatgtgggtggtgtatatattttaacttgggcattattataaactgctctcactaagtcttgcttcatctaagtatgtccaggttgtgccgacatgtgtcataggtggcttcgttatcacccatgaaggcacagtcagaatgttcatctgtagaaattatacccaatttaaatgtcttttggagtgtttgatttaaagaaagactatcaagaatctttttgtgacgaaaacagcaccatctttatttctcttttgggaagcctagtaatgttggcctgtgtttgcctcagacagaaaatctgtccccaccttccactgacacatgaaagaaaccttgctgtcccctttcagcttttccaggagttggtgactaaatcctgtcgcttctccctctgctggacctctgcgtcctctgctttgctttccctccctcctctggctcagacatccactgcctctggggagaccactgcagtcagctctaagtgggaattcctactctgggcttctccttctctccttcaggggtgagcatggctgctggactagccgcccaattttgtaaataaggttttgtctgaacacagccaccacaccccttcatcgcagatcaattttgctgtccagcctcagagtggggtaggtgtgacagagtccatgtgcctgtaaggcctagaatttgtatgatcttgtcacttatagaacaggcttgctgacccctgctctagttgaccccatgcactactcaggatgtgttattctcaagttctgaaacttggaatgcttcccttttggttcccaccttggaatgtcacttcctactcaagcaagcacatggactactcttgctgctgtggtagctccattcaagtgatctttgacctgtcacctttgcatatttcacagtggcttgtttggtgggacagcagggggtatgaccttccccgtggtatcacagttgtgtactcacaatctatctgggtggaaaaagttgagctacagaatttcattactatcttgtaaaaccctttggagtaaataatctataaagaagacaagtagtgtacattttcagagggaagacagtctttacctgggcacctatcacatgtcacagttgctaggacacagcccttcgggcagcttgggatcctgccagggtggccacctccaaggctcttttctctttattccttggctggaaccgtcaccctgcctggcacagagaagggcttagtgaggtttgtgggggtgaactgagcattctcctcgtcacctacagggggtcttctgtttgaggaaaggtagccaccatttctaggtttgatacaagcttcacggaccgctttcttgcccttctctggcaggtgggcattaactaccagcccctgacggtggtccctgggggaaacctgaccaagttgcaatgggccatgtggatgctaagcaacatcacagccatcaccaaggcctgggcctgcctggaccataagtttgatctcatgtatgccaagcaggcctttgtgcaatggtacatgggggaaggcatggaggagggggagtcctctgaggctcgcaaggacctggcagctctggagaaggattatgaagaggtgggcatggattctgtggaagcggaggctgaagaaggcaaagaatactgaggggagggtgtggtgggctctcctgccgcccccagcatggctgctttcaggttgtttgcaattaaagtttctctataaaaccaagacctctgtgtgtcatgctgcttggctctgcctacaggagcaggtgggaccccagagcctgcatggacagtcagtggggtcccagcctgccctgctggcatgcggttggggtgcagcaggagtgtatgtacttaaggagctgccatggaagtgacttgacccaggagaaacaagccaagcgttgagtggataggtttcctaaattctaggaaagctaagtcagggtttcaactgaatttgcaatttttggggcttttctattgatgggatgtactggctaaaaagaagagcctagaagcagagtgtttaaatctgaggtctatgaatggggcgtgtccatgaaatccctaaagctgtaggtcaaatgtgtaaggtcaggacattttagaagggggaaagtgttactgagttctccacagtatttgtgacccacagaaggtcacaacacacccatcctgaccccccactgctccatggtaacctggaaggcagcatttaccctccacgcacacacacggtcaccttgcccctcagcattgtcaactgtcttggtagaaaaccttgcacctttcacttcaagtgaagtgtgttaacatctgtttgtaaaagacctgggaatccagatatcttttctcagaaccaaagtcagctccaggaagttgactcaaggtgaagtgacctggttagttcagctgtggcacaaccaggacctgcataaaaacctcattctatgtttgtgccataatatcatcaaaaaacagtagagaacatatgacccggaccctctgcatctcagaaagacttattatcaactgaaggagacaacacgtagcctttgctggggacagtggtgtgacaagtctctggcccatcctaggtgctgccccgcacctgctgccttcttccaggcccaccccacttgggcagcctggtagcgctgggctggcggggtgtcctctggctggatcctttgcggccgctgcattccaacagggccggcactctcccgagggaggtgctgtctttgtttctccctgaggagacacaaagcgcagccaataggaacggacgagccccgtaactgcagcacctactgaagtgtgctccttgagcaacatttgtgtctgcacatttccctcaaagccacttcaagctgaaagccctgtatcagtcctgagtcctgaggctcagaactgccaaaggcaggtcatgccccagaagcccttggccacgggtccatttagggaagggtaagggtggctggtccatacttggcctggacaaggaacctggtctgccctgatggcgccaagcagcagcagcagcagggacttgccacttcatcctccaggtgtgttcacgctgaactgtacatctgagctgccttagatggtgacaggcaggaaacactccagtcaccaagtactggaattgggtttctgattttgattttggaagctctcacattgtttcctacctacccgagtattctgcaaacagtggtcaagccttgtagggagacaccctgaaactattgctatggaataaaagatgaaatgctcctgattattgtaaatacaaaattgcatgcaggattgtgtaaagacaatgccagcttggactgccagaacgagccaacagcacgtgatgtccttccacctgcagagagcctatgaatggacgtgcagtcagggaggtttcacatcaccaagattcctatcccagaaaagcagatattcatagctctgggaatggaatgcaacccttgtggagagcctataaacggatgcatggggggcgcctgtccatatggataagatacggctataaacgccctcatcttgccacagctcttctaggcctctttagggtgaaggcatactcccttctgagaatttctggtctaaccagttgtctagcttcacgtcctgtttccatggattgtttgtaaccagcttttgttgcaattgttactgctgattaatatcttgctaatcataggttatggaaagactgtgtttctgttctaagactctgttagaaattactgatgcacacactatattgtaaattcttatctttgtataccgtacttctacatacaaatgtactgtacttctacatacaaatgctatgttaaagaattacttcatccccatgtgaccatctcacctcataatcaaatgaccctaaatccctcactaacctacccccgccctcactaaacttaatagtaaatgctggtatatccagtgcattgttggcaccatgggaccagaaggcagtgaccccctggacccagctttcactatcttgtgtgtgtctattatttctcaacctgccaatccacctaggagcaaagagagagccccattgcattgcgggctgctggccagatccctcaataaagcctctcactctggagtttagctactggattccatgactgggttcctcccgtggtctgaatgcttgagactttccttctgaccaccagagaatcccagatgaagaccactggttcagatttccctcgatttgtaatttgcttactcctttttgtgaagatagaaagatctgcaaccacacttgggccagagctttattttaacgggatggatttccctggacttggtgttgtcagcatcagcaagaccgagaggaccctctagaggacaaatgtgcttgggtagaaggcttgcccatggggtcacagccccccatgtggagtaccttggccagggctctcctttgctctggcctggtagagtctgccccatgggctctaaccagggcatgtgtcccctgcttgactcacagtgttgggtctcccattttgtccccccagctttgtcctgaccaagagtgtgccttgactgctctgtgacctggtcagctgtatgttccccctgcaggctcaaaccctagctggggccttgcttcttaccagacactgataaacatgttgtttgttgcctgaaacagtaaaagatctgacatgttgctaagcatgtggaaactggccccgccccagccaaattccttgcacccttatataaactccacactccaccccctcactgcagcatgcctaggcagaacctccatccttgccgtccctcgtgaggccatactgcagccttgtgtgtatggaagttcccctaacacatgctttggactgaccaccctcacattaagtgcttcttcctttggaattccaactggctctcatcccaactggctctcagtcacccaagtggaaggtctggggcagtcccttgcgggagctctcctgccaccacttttggggtgagaccagatgacggttcagccaacagaacactcagcctcaatcctggttcttccctggcctcttaccaagtttagtcaaatcacctgcaattggaaactgcgctcttgaaaaaaagatgcaaccaggtgttttagggatccatgaggacatttccgtttcaccatttgtcatcttgaacaagtggaggctcctgtgtctgagacgccatggatcttggctactccagaggccactccagctccctttccatgccaatactgaaaagaaaattctccccaaatccctgcagggataggatggccctccttgtgagagtttctggggagttcttcctcagagaatgagatctttgctgctcggtgggtggtgaaggttatggtggtgtcacgcttggaactctgtcagcttggcacactcaactcaagaaagacggagtcagggttgcccagaaccaaggaggggtgcagccagaagcatgtggtgggtgaagtttggccacctcagtctaccagtgactcgtggaaaaggcacaaagcagagaatggccacctcgcatttcctttggtacaaactgccattattttagtctccactgactggtcgggggaaggaccccatctcccatgagcagatgagccccaccaccctgcagcagctcccacaatgggccagcatcctcctctgaggccacagtccctctgcgggccaggccagacagagtcagagcgtctgtagccgcggtgtttaggtgtccccgtgctctcagggtgactaatgtccagctccccacagcacacggcagggcagtctgcagacctgggcctgactcagagctggcttcccttcagcttggcaccatctgagcttcctctcttcccctcagtaatgactcggtcccttctggaaacaaggatgagagggaagcagaaaggaggaagtaagggttttgaaattttttttaaaatttttttggtttttagagactgagtcttgctctgtcacctgagctggagtgcagtgatgcaatcacagctcagtgcagccttgaactcatggcctcaagcaatcctcctgcctcagcctccagagtagtgggactacaagcatgtggccacacctgactaataatgcttacctttaaatctgacagggctgacaaacccttaacataactttgagccataatggatattaagaaaacaattctggaacccttcaggaatcatgtgctcttggggttagtgaggagccctgttcaggcctcctcactttatgaaggacgaggaggcccagaagagaacgacctgcagcatcttgcagtgggaaaaccagcttttttttttagctctgctcccttgggaggggctactgagtcagatgggttggacagtggggttgaaccaagtgttactgcaagttgggggggagggtggggtgactgatgtccccaggcctggtccctggagggtccttctatgcaccaaaaacagtcaatgaccaatgcatgttaaaacagacttcatgctataaccccaggctttgggaggctgaggcaggaggatcccttgaggccaagagttcgagaccagtctgggcaaaaacgtgagaccctatctctaaaaaaaaacaaacccaaaaaacaaacaaaagctgggtgtggtggcctgcacctgtagtcccagctactcaggaggctgaggtgggaggatcacttgagcccaggagtctgaggctgcagtgagccatgattgcaccactgcactccagcttgggtggcagagggaggctacctctaaaaaaaaaaattagattaacaaaacttaaaaatacaaaaataaaacaacaacaaaaccaaaaacagcctggctcattctcttcaaggtcagtgctcctgctactctgaaaccagctggtgaccactcggcattttgtgagcccctaacgaagcaaatctcaaaatgcagcagcctgtcagcctctcatgatctggggaatccctgaagctgcggagtgggccagaccaagctgggacgccctctgccatttacctttggtgtggcctatgtgagcccaactccccaccatttcccatctgggcagagctggttggggaatgaagatgtgtcccttctgctggtccccaagggtggcctttcttgtttcgtagtggcagcgcgaacttgcggcaacatgggctgaccaacatttgtgttaggaaggaaaacgggcagaggtgacgtgagagaactgagagggaaggaaaccaccactggccctgcttgagaagcagccgcagccagggcaggtggcatcagcagtggtgtctcactggcaggggcaggggcagcacagcaggccctttagtctgtggctcgcctaatactcctgtcggacagtgctgctccaacacattcatgacatgccttcagcaaacccaagtcaggggcatgagccacacatgcaattttttttttgagatggagtttcgcttttgttgtccaggctggagtgcaatggtgcaatctctgctcactgcaacctccacctcccgggctcaagcgattctcctacttcaccttcccaagtagctgggactacaggcatgtgccaccatgcccggctaattttgtatttttagtagagatggggtttcgccatgttagtaaggctagtctcgaacttcccatctcaggtgatccacccgcctcagcctcccaaagtgctgggattacaggaatgagccaccacacccagccacaattttaaattttctggtaaccactaaaataaaagaaaatgtggaattagaattcaaataatatattttaattaacccaaaatatccaacatattatcatttcaacatgtaatcagtacataagtttttcatgaaatgttgcaatcactttttttttcctttttatttaaatagagatgggaatctcaccatattgcctaggccagtctcaaactcctggactcaagtgatccacccaccttagcctcccaaagtgctgaaattacaggtatgagccactgtgcctggccctgcattcacttctgttcttttgtttgtagacactggatctcgctatgttgcccaggctggtctcgaactccttgcctcaagtgatcctcctgccctgcctcccagtgttgggattatagccgtgagctaccacgccctgcattcacttttgtgccagtcctttggcacctgctgtgcataacacacgcagtgcagtgaccatgccagccatatatagctcgtggttcccgtatcaggcagcacagctcatgtgagactcatggcttccacataccaaacgtcatcttacatgctctggacaactttaaaaaatgtgtagtttccctaaacttagagaccgcttgactgcatttagttttccctcaatgactccagaccctcaccacaagcattgcccgtctgttctggtgtcttctgtttcccctccctgtgggtatgagtgagcctggtggcggtggtccccgcaggctgtctggatggctgggggacaggcatccagagaggctggggcgcctgctgcagttcacagaggcaggcttgagtgggcctggcccgcggcctggagaactccacacccaagtcctgtgtgaaatctatggcctccatgccctccagctggatcactctgacaaccccctcttatgttctccaccccagattctgccattactggggcagctggagctccgtgtgtttggatgctgcaacacgcgggtctcagagagctctcggtatcccatctgcgggctctgcctctcactccgcagcacactcctggtgtggccccacctctgccccactcccctccaccttctccccaggtttccctctatccccacggggcatccccccagggcctctgtgccctcatatcctggccttctgccacccagcctgcaggacagagcccttgaagagcaaagaccctgaggggcccagcatgccaggccgctccagtcctcgtgttttgggtatcctctcacttctctcggagcccccgttcacccacacggcacccctgatcctcctggcccctttatgcccgtgttcccagcaccacgacccccgcatacatcttttttttttttttttttttttgagatggagtctcactctgtctcccaggctggagtgcagtggcgtgatctcacctcactgcaacctctgcctcccaggttcaagtgattctcatgcctcagcctcccgagtggctgggattataggcatatgccacaacacctggctaatttttttttttttttttttttttttttgtagaaatggggttttgccatgttggccaggctggtctctaattctggatctcaggccatccgctcgccttggtctcccaaattgctgggattacaggcatgagccactgcgtctggcccccgaatacatcttgactatgtcctgccacctccctcctcctgccctgggcccaccagcgcctggacagcactctgcctcgcccaccccctcccaccaccccagctcacaccttcggggctctgctgacccctcctgtcccgccctgtgtaacccttactgctctcctgctcagaagcctcctcctacctccatcattggcggtttttctcgccacctctcattggaacgagtgggaccatctcacttcactgccacaccctctgcactgacagacagccgggcccggcacccagaatccctgggtgaatggcaacatcccttagaatgacaaggactctgttcccagtttcttcctccccgtggaaacctgcccttcaattgctcatctcagcctgcagtccgtgcacccctaccccagcctgtccctcagcccctcctcaccctcccttgggcctgagctctggttggcagtgaggtgggcgctgtggggaggagcgtacaggaggtgcgaccagagccccttgggctctcacaggcccctggctctgggcccctggtttcatcacacctggtgacacctggaaggtggccccaactcaggagtgaggcgggcaaaggggctgagtgctggagtgtggccacgggaccagcacacggcatctgtgtggtgctgcccaggaggctcggagaaggcgggagcctctgtttcagcctccagacttcctgtcggggtaggggacagcttctaagaggcaaggtgtttgtcacgcctggggctgtgctctccagcacagcacaccacccctcagcctgctgtcctcccttggggtgggtggaattctttacagggcacaagtctcactcaccacagttcgcctctggggtgtgggatgttgatcctgtccccagatgccagcccaactgtgggccataccatgtctctaataaacagagccagaaatcgtgccctgtcgctaagccacagggcagcgttggcctacatggtcttgcccttgcagcttacaggttttcctgcctcctggggccgggcactttccatggaaacaagggagagcaccaaccaccagagataagccaataaccacgacctgagaaagaacaggcagcaagagaggcggagggaatggggtggggtaggggctggagagaaaggtgagtgtgtggcagccaggctgtggggcagaaccggagagcccgcaggccaagggcccaaggaaaagaggggttcgcagtggggttattgttcctggcagagaaaaaggaggcctctggaggtcagagagagacgcaaagagagcagacagagcgcggggtcagtgaggcctctgcgcaggtgcctggggcctctcagggcagggggactgggtgcccaggccctgcccccatgggggcagccggctctccgccccttctcaggatgcctgtgtgggtgtcctcatgcttccaggtggggagccagctctgggcctccttccagtggccggggaggttttgctgcatttcagagggagccgtcaggagcagaagcaacatgtggggaggaaagcagagacggaggctccaccatgacacactctcagcctcagcatctgctcagccccagtcaccatgctggagagaggaggcccttcaggccccgcaggcctctgtaccctgggagttctgcctctgactcttgtcctgcaatcctcagagggaagctggccagggctggtcaagcccctgcataggacctgggcccaagtggggtacaggcagggggtggcaggaagacttctgcctgccctgctccctcggcactttcctggaggctgtaatgccacaagacaggatcaaaactgtgctgttgtttttttttcgagaggagtctcactgtcacccaggctggagtgtaatggtgtgatcttagctcactgcaacctccgcctcctggattcaactgattctcttgcctcagcctccagagtagctgggattacaggcgtgtgccaccacacccagctaatttttgtatttttagtaaagatagggttttaccattttggccaggccagtctcaaactcttgacctgaaatgatacgcctgcctcagcctcccaaagtactgggattacaggtgtgagccactgctcctggcccaaaactgtcttttaaaaatatttttgggggtgctgggtgtggtggctcacacctgtaatcccagcactttgggaggccgaggtgagcagatcatgagatcaagatatcgagaccatcctggccaacatgatgaaaccccgtcgctgctaaaagtacaaaaaaattagctgggattggtggcgcatgcctgtagtcccagctacttgggaggctgaggcaggagaatcacttgaacttgggaggcggaggttgcagtgagccgagatagcaccactgcgctccagcctggcgacaaagcgagactccgtttcaaaaaaaaaaaaaatcttttttttttttttttttttttttttacagacagggtctcactctgtcatccagactggtctcaaactcatggcctcaaacgaccttccccccttggcctcccaaagtgcttggattggaggcatgagcccctgcgcctagcccaaagtcgtcttgattcctgactttgtggaatggaggcatgagtgaagaggtggggagaggctgaggaggaggagccctagcccacctggagcaccgtggggcacgcactctgcgtccacctggcctggacatgcctcctaaggataacagcgaagccagggagcagagcccacggatgggccctgcagctgctgggctgagaccgacagacaggcgtggtcactccgggccatgctggcgctgtgctgcccctgcccctctccaccccacctcccgaccactggggcagggacaatgggcccggctctgacttcgggcacgctcgtcgtgtgcagagacacggccgcagagtcctggggctcgctcgccatcctctgcccggcacacatcgacttgagcatctggaagacggccacgggggccacgttcaacttcacctggctctgaagctggccgctgtgggctgcatgagaatggtgtttctataaaacatgggaattgctggtcagacacagtgactcatgcccgcaatcctaccattttgggaggctgaggcgggaggatcgcttgagcctaggagtttgagaccagcctagggaacacagcaacacctcatctctacacacacacacacacacacacacacacacacacacaattagctgggcatgatggcatgcacttgtagtctcagctactaaggaggctgaggtgggaggatcacttcagcccagattgaggctgcagtgagccatgatcatgccattgcattgcagctacttgggaggctgaggcaggaagatcatgtgagcccaggagtttgaggttgcagtgagctgtgcctctaatcccagcactttgggaggctgaggtgggcggatcacaaggtcaggagttcgagaccagcctgaccaacatggtgaaaccccatctctactaaaagtatttaaaaaattaacctggtgtggtggcgggcgcctgtagtcccagttactcaagaggctgaggcaagagaatcgcttgaacccaggaggcggaggttgcagtgagccgagatcatgccattgcactctagcctgggcgacagagcaagactccgtctcaaaaaaaaaagattatgctgaaatttaccactattggtatgaatgatcagtattcaccaagcatatctgaacatgcaaatgtttaagaaataagcataataaggatatagcttgggttaataggattctcatagtttttttcccctatgaaacataagtaataattttagcatatttattatggattatactcatttaaaaaggactttaagaagttgtgctttgggaggcagaggcaggtggatcacaaggtcaggagttcgagactagcctggccaagatggtgaaaccccatttctacaaaaaatacaaaaattagccaggcgcagtggcgggcacctgtaatcctagctactctggaggctgaggcaggagaatcggttgaacccaggaggcggaggttgcagtgaactgagatcgtgccactgcactctagcctgggtgacagagcaagactccatctcaaaaaataaaaaaaagaagttgtggatgtgaataatacatttctctaataaaaatttaaattgtataatagtttaataaagtgtttacattcattgatttttttttttttaagacagagttccgctctgtcacccaggctggatttcaatggcatgcgatcttggcttactgcaacctctccctcctggtttcaagcagtcctcccacctcagactcccaactagctgggaccacaggcgcgtgggttaccatgctgggataatttttgtaatttttttgtagagatagggtttcaccattgttacccaggctctgtgctcaagcaaccagcctgcgtcagcctcccaaagtgctgggattacaggcatgagtcactgcacctggcctcagttatcctttctattacatcctatgatgttttcatagcctacaaggcatcaatttcttcttaataattgtcagtctggccaggcgcagtggctcatgcctgtgatcccagcactttgggaggccagggcaggcacatcacctaaggtcaggggtttgagaccagcctggccaacgtggcaaaaccccctctctgctaaaaatacaaaaattagccaggtgtggtggcgtgtgcctgtgattacatgctacttgggaggctgaggcaggagaatcacttgaacccaggagtcagagattgcagtgagctgagatcgtgccactgcactccagcctgggcaacagagtgagactctgtttcaaaataataataataataataatagtcaatctggttaaagaggtaacaatgatctattaatgctttgggaaaacaatttgggttgcctttgaaggccagggtttttagttcattcaaaaatatttatttaatttatagcatgtgccaagcattttttagcttcacagtatacagttgtgaaccaatcagataaggccctaaccatttttggcattctgtctagttggggtgggatgggggcttaattaagatagagatatagaaaaatgcgcatctatataacataagtatggagttgagaggaagcaactaacagtatgttagagatgttagaagtaatattttgcaggtttgtaacctctatttgacttttaagtttgggtagtgttaatagttgaagatagtgtaaaaaagccttaattttcactttccttgctggtaaaggtatgtttatttagactgttcatttatttatttctcactctgtcacccaggctggagtgcagtgctgcaatctcggctcactgcaagctccacctcctgggttcacgacattctcctgccttagcctcctgagtagctgggaccacaggctcccgccaccacgcccgggcaatttttttttgtttgtttgttttgtatttttagtagagagggggtttcaacgtgttagccaggatggtctccatctcctgacctcgtgatccacccgcctcagcctcccaaagtgctgggattacaggcttgagccaccgcgcctggcctagactacccatttaaagtagtgtttaacatggctgggtgtggtggctccctgtaatcccaggagactgaggtgggcagatcacttgaggtcaggagttcgagaccagcctggccaacatggtgaaactcagtctctgccaaaaatacaaaagttagctgggtgtggtggcaggcacctgtagtcccagctactcaggaggctgaggtaggagaatcacttgaactcaggaggcagaggttgcagtgagccgagatcgtgccactgcactctagcctgggcaacagagtgagactctgtctcaaataaataataaatacatacatacataaataaaaaaagtagcatttaacacaacaatcctgtgaaagcgattctattacatatccacaagctaattagctgcacactctttcctgtattttacaatttagcatgattttaggccccagtcttctcttcaaatcactggtgttttacatttggcaaagaataggaagttacttttgatttatggagtgattatattattactttaaaaatgtgttaatattttaggacagtttggagcctctatctttttttgagttagtatttcaattctcattacttattctaacagcttctaagtgaaaatagtatttaggcaattaaatcggcatatgttttcaggaattttctttcatttttaagttttgtcatcattgaggttaatgttttaacctggtgttcagttatgatatatataaacagtttgtgaagtgaaatagtcttaagtatgatgtgtgatgcacctacaaataaacgaaaatggcgtgcaccatgtctctttactgtgggaactgtactggaagatttatgaaagcatgtgacattgcacctaaagttgtgttattagtgactataagcagcagtgctaaatttttctattgtacttgatgaatgaatgcatttagtctagtcacagttactttggtttaaatgcatttgtctttagggtttgtattagttttcacattgctataaagaccccagactgggtaatttataaagaaaagcaatttaattgactcacagttccacaaggctggggaggccttaggaaacttacagtcatggtggaagaagaggcacatcttacatggtggcagacgagacagaatgaatgagctaagggagaagagccccttataaaatcatcagatcttgtgagcactcactcactattatgagaacagtatgggggaaacacccccataatctaatcacctcccaccaggtcccgctctcaacacatggggattatatggattacaactggagatgagatttgggtgaggacagagccaaaccatatcaggtttttattttttttagtattttattttattttattttttgagacagagtctcgctggagtacagtggtgcaatctcggctcactgcaagctccgcctcctgggttcacaccattctcctgcctcagcctcccaagtagctgggactacaggcacccgccaccaccactggctaattttttatatttttagtggagacggggtttcaccgtgttagccaggatggtcccgatctcctgaccttgtgatcggcccgccttggcctcccaaagtgctgggcccatatcagggttttaaaaaatgtgtttgtaatttgtactctcggcagggtattcttgggctgcaggggttgttgtcaatgtgtgatttgtgtttttattttatagaataatgtgatgtaccgatttttataagtgatagataattcgaataactgtatatttgacaacctattaaaatattttgcattggaacttctttcattaattgtaacatgctaacaaactgatagtggtttaaaaataactcattcattgaacaacaacaacaaaagaaaaaaggttaaaagtaaacatttttatgggaaatctcttatccaaaattctttcaagattttaccttatttagtgactagttctgtatttttgcatgaggaataaatatgtctctggaaggaaaaaaactattgctattaatagttatatgaaccttctagaacctaatctaataccagacaactgaggctaaagaaatgctagattgcagccccagtggccagacatgaatataagaaggaaaacaggctgggtgtagtggctcacgcctgtaatcccaacatatatatgtatatattgtggtggctcacgcctgtaatcccagaactttgggaggccgaggtgggcggatcacgaggtcaggagattgagaccatcctggctaacacggtgaaaccccgtctctactaaaaatacaaaaaaaattagcctggcgtggcagcgggcgcctgtagtcccagttactcaggaggctgaggcaggagaatggcgtgaacccgagaggtggagcttgcagtgagctgagatcgcgccactgccctccagcctgtgcaacagagcaagactccatctcaaaaaataaaaataaaaaataaaaaataagagtttagtcctcacatacctatgttttacatcaatccccaaatagttctttcccacaaagcatactggaccaatagtacagaaatgatttgtcaacttccaactttgtccagctagaaaaacactagaagccagttaaaatgtttgagcaagacaggacaaatgctctgtttcttccacaaacaaattgcaaataggaaaaaaggagggagaaagagcctatagattaaaagagatttatgaagtgtgctatccaaatgccaggtgcagactttgttttggcttctatgaaacaagtcaactttttttttttttttttttttgagacgaagtcttgctctgttgcccaggctggagtgcaatagtgtgacctcggctcactgcaacctctgcctcctgggctcaagcgattctcctccttcatcctcctgggcagctggaattataggcacccaccaccacgcctgggtaatttttgtatttttagtagagatggggttttaccacgttggccaggctggtctcgagctcccgacctcgtgatccacccgcctcggcctcccaaagtgctgggactacaggcatgagccactgcacccacccaaaacaagtcaactttttaaatgaagaaatttaaacaaacactgaatatttgatgattttgaaaaattactgttatttattttttcaatgtcatattactatggctatgtttttaaagaaagcccttatcttcttgaggtatactgaaatatttaaaaatgagataacagatgactggcatttccaaaataatcctttttgggaaaagggataagagtgaaatatgactgattatgagttggtaattgttggaacttggggttcatttttctagactctactttttaatgtatttggaactttattactaattgctatcactttcattaatactgattacagaaataaaaaatcaacaaatgaaaaattcaagacacccccaaaaaggaacaatgacattttcatacatgatatcatctactatttcaataatatctaaatagaggacagttgaggatgtgacatggaatactggggtagaatttttttttgaaacggagtcttgctctgttggccaggctggagtgcagtggtgtgatcttggcttactgcaagctccgcctcccgggctcaagaggctgagacaggcaaattacttggggccaggagttcaagaccagcctggccaacatggcaaaatctcgtctctactaaaaataaaaaaaataagtcaggcatggtggcacatacctgtagtcccagctacttcggaggctgaggcatgaagattgcttgagcctgggaggcagaggctgcagtaagccgagattgtgccactgcactccagcctgggtgacagagcgagactctgtcccgtgccccaaaaaaagtccattgtgattcttgtcgttgtcttactgttgaaatgtttacctaagtctttcgttcaaatgggatgctcgagaacacttcaggaaaaatgagaaacaattaaaattctccaggccaaacttctttatttatttatttggaaggagtttctctcctgttcccaaggctggagtgcaacggcgagatctcggctcactgcaacctccgcctcccaggttcaagcgattctcctacctcagcctcccgagtagctgggattacaggcacccgccaccacacccagccaattcttttttttttgagacggagtctcgctctgtcgccaagctggagtgcagtggtgtgatattggctcactgcaacctccgcctcccgggttccagcgattctcctgcctcagcctcctgagtagctgggattacaggcatacaccaccactcccagctaatttttgtatttttagtagtgacggggtttcaccatgttggccaggcatgcaccgccaggcctggctaattttgtacttttagtagagacggggtttctccatgttggtcaggctggtcgtgaactcccaatgtcaattgatcctcccccctccacctcctacaatgctgggattagaggtgtgagccaccgcacctagtctttttttttttttttttgtatttttaatagacacgggtttcgccatgttggccaggcttgtctcgaactcctgacctcaggtgatcagccgactcagcctcccaaagtgctgggattacaggcgtgagccatcgtgcctggctgccaaactttatttttaaaaacatttaaggctgggcatgttggcttacccctgtaatcccagcaccttgagaggccaaggcaggagaatagtttgagaccaggagttcgagaccagctggggtaacatagtgagaccccatcccaattaaaatatatatatattaaaaatattaaaataggctgggtgcggtggctcacacctataatctcagcactttgggaggccgaggtgggcggaacacctgaggtcaagcgtttgagatcagcctgtacaatatggcgaaacccagtgtctactaaaagtacaaaaattagctgggtgtggtggcatgagtctgtattcacagctactcgggaggctgaggcaggagaattgcttgaaccaggaggtggaggatgcagtgagctgagattacaccactgaactccagcctgggcaacagaatgagactctgtctcaaaaaaataaaaaattaaaaaataaaaattaaaatcatttaaagttcatttctttagaatatttctctcaaattataaatgtaatattttaagcttcagtaagttaaagttacaatacaataaaaaagaattactgtagcaggagaaaaataaaccatgagtgatgtagggggactattaaatggatattaattcataacagcatggatttttaaagttttttccttttttttttttttttttttgtgacaggctcttgctctgtcacccaggctggagtgcagtggcacgatcatggcttactgcagcctcaacctcctgggctcaagtgattctcccacctcaaccccttgagtaactgggaccacaggtgcgtgccaccatgtcaaaatcattttgtgtgtgtgtgtgttttttgtagagatggggttttgctatgttgcccaggctggtctcaaactcctgggctcagtgatcatctgcccttggcctcccaaagtgctgggattataggcgtgagccactgcgcctggccttttccttaatattaaatgaagtattatttatattacaaaccaattatttggagaaaccccgtctctacttaaaatacaaaattagctgagcgtggtggcacatgcctgtaatcccagctactagggaggctgaggcaggagaatcgcttgaccccgggaggcggaggttgcggtgagccgagatcgtgccattgcactccagcctgggcaacaagagcgaaactctgtctcaaagaaaacaaaaaacaaaaaaatacaaacaaaccaattattacgaaaatgctattggagaaagaaactgtaaaatctgatcaactgaggatctagcagtactaaaaaatatcaccattcaatcaggacaactagcaattctatattatatttagggaagttttctaaataatccattgcaaagtgaacaattgaggattaacagtctttgaagaaaaataattaaaaaggcaaagttccaaggtgaatgaagaactgatgcagaggaaacagatacatcagagagcataagaaaactttaaaaaattccagtgagtgtggtcagaaagagggaaaggggtgtttcctcacctcaccagctacacaatcataaagcagtgtagccttcatgagggaaatatttcaacccaagaattccatactcagtcaaatcaactaccagaacactgagggcacaatgagacattgcgagacattcaataacttgaaaacattaccatcctcaatccctatgggggaaaaaagaaatgttacacaatcaagcatgtatgtgtatacataatatgtatgtatgtataatacatctacatacatatagatattcctgctgcccacgaaaagactagcaaatcatcagaagagtaatccaaaaaacctgccgtgaacataaaacagtggcagctgactatgatctagaagcagcaaagaaagttaggaagaaaataggaggagggctaggcgcagtggctcacgcctgtagtagtcccagcactttgggaggccaaggtgggtggatcccctgaggtcaggagtttgagaccagcctggccaacatggtgaaaccccatctctaccaaaaatacaaaaattagctgggtgtggtggcggccgcctgtaatcccagctactcaggaggctgaggcaggagaatcgcttgaacctgggaggtggaggttgcagtgagccaagatcgtgccattgcactccagcctgggcgacagagcaagactccgtctcaaaaaaaaaaaaagtaggaggagctcttcagtacccaagcctgcacagctctctgcaaaagcagcggggcatctatctgccttctctctgggtccagtcacaccacgacttggctttgcagggaataaaatgtgcattaccataattattataaatgctatttactggttttcaattcttatgaccaacttagacaaaacaaagaaaacttcattatagtcacagaacataaacattatacattttgacaacacaaaactgatatactcctaattctcaaatgaaaataaattttaaggtggcagccacagatataaaggaaattaattaaaatacgattccatgttaataagctagaaagtattgataaaattgatggtatttctaagagactataatgacaaaatcagcaaaagaaaatctaaatagaatactaattttggaaaatatttggaaagaagtctaacaatatctcccactgaaaagcactgtatttgcatagttttgtaaatgaatactttgaaacttcattctctgaaatattctttttttgttttcttctttttttttttgagatggagtttcgctctgtcgcccaggctgggtgcagtggcgtgatcttggctcactgcaagctccgcctcctgggctcacgccattctcctgcctcagcctccagagtagctgggacttcaggtgcacgccaccacgcccagctaatttttttgtattttttagcagagatggggtttcactgtgttagccaggttggtctcgatcccctgacctcgtgatccacccgcctcagcctcccaatgtgctgggattacaggtgtgagccaccgtgcctggccctgtaacatattcttgaacacaagactggacgctttatagtttttcctaaaacttgatcataactctgatactacagtattccaagggtaatatacaaaagttaagaccacagactacagactactcctcatttgggaatatcgtttaaaaaaataataaaacatgaatacaaaaggctcaactgtgcaggtagagaataaaatgccatggctaagtgttttattctgggactgcttgaatgattccatagtattaggcatattaatctaaacaagaaaaatagtcaaagacgaaaatcacgatggtcttgaatagccatatttcaatattaatttctcattaaaagtcttagacttttagactaataagagtttttttaatgtttaaaaaaatctgactgggcgcggtggctcacgcctgtaatcccagtactttgggaggccaaggcgggtggatcacgtgaggtcgggagttcgagaccagcctgaccagcatggagaaaccccacctctactaaaaatacaaaatttagctgggcgtggtggcgcatgcctgtaatcccagttactcaggaggctgaggcaggagaatagcttgaacccaggagacgtgagttgtggtgagccgagatcgcgccattgcactccagcctgggcgacaagagtgaaactctatctcaaaaaaaaaaaaaaaaaaaactttcaaattaacattcaattttaatggaaaaagtctagaatataccttaaaataaaaaacaagtaaaatatttatagtaactacgaggaaggaggctttcacttttcatggcataccctcctgtaatgtttcaatttattagttttgagcatcctttttttttttttttgagacaaggtcttgctctgtcacccaggctggagtgcagtggcatgaacgtggctcaccgcagccttgacctcgtgggctgggaacacaggcacaccacagccatgcctggttaattttttagtttctatttttagtagaaatgggctctcattatgttgcccaggctggtcttgaactcctgggctcaagtgatcctcccaccttggccttccaaaatgctgggattacaggtgtgagccacctcacccagcaataactgtcttgtgacacaaacaggtggattggtgctgtcatcaataataattgtgactaattagctcatcaggtcctaggatggctttggggcagcagttggtgcaacttctggtaacttctgtcatcaaactctggttatgtggatgtctctgagtcatatcaatgtagtagcctcttctgagtaggaatggtatttgtgtgtctctgggtctgaatccctcgtgaaactataagctccttgagggcaggtattatttctcattgctcttagcaagtcacctgttgtttggcatacccagctgtcctctggagactgtcctttactttctgcatccacatagctatagtaggagccaccatatttgcgcaacatggccctaccaatggctgctgttgactggactggagatagagcccatcttaagccaagccactgaaagcctcatggccccactcatggatgttgttgattggactgtgggtagggtccaacccaagctggaccaatggagctcttcctcaagattttggaattaagtttaagagaagggatcttactgacccagcttgagtatttagaggagctgttgacaccattatttttcctgtgaacagggaactagttaacgaagagaagtggtgctcatagaggagaaaaaagaatgagggacacagaaaaaatacatcttagatttcctggcatctctcagttcctgtttccaggcctgtagggaaaagaaagagagatcagactgttactgtgtctatgtagaaaaggaagacataagatactccattttgatctgtactaagaaaaattgttttgccttgagatactgttaatctgtaactttagccccaaccctgtgctcacacaaatatgtgctgtatggaatcaagctttaagggatctagggctgtgcaggatgtgcctggttaacaatatgtttgcaggcagtatgcttggtaaaagtcatcgccattctcgattaaccaggggcacaatgcactgtggaaagccacagggacctctgcccaagagagcctgggtattgtccaaggtttccccccactgagacagcctgagatatggcctcgtgggaagggaaagacctgaccgtcccctagccctacatccataaagggtctgtgctgaggaggattagtaaaagaggaaggcctcttgcagttgagataagaggaaggcctctgtctcttgcatatccctgggaatggaatgtctcggtgtaaaacccactagtacatttgttctattctgataggagaaaaccaccctgtgcctggagttgagatatgctggtggcaatgctgctctgttactctttgctacactgagatgtttgggtggagagaagcataaatctggcctacgtgcacatccgggcacaataccttcccttgaacttatttatgacacagattcctttgctcacatgttttcctgctgaccttctccccactatcaccctgttcacctgccgcattccccttgcggagatagtgaaaacagtaatcaataaatactgagggaactcagagaccggggccggtgcgggtcctccatatgctgagcaccggtcccctgggctcactgttctttctctatactttgtctctctgtcttatttcttttctcagtctctcgtcccacctgacgagaaatacccacaggtgtggaggggctggccctcttcacaggcccctcccaaaacctggctgcatcagatctccccccaccccttcactgcttgagtcaatttgagtgagtctgttactttcagccaaaagtatcccaaggaatttagagcctgagagaagtccaatgtcacactgcaggccaatgaagaactatcctctttctgctgactctcaaacgcaaagttctttggggcaagaaagaaacaaggaagaaaaaaatcactcacatctgttgaagacttactatgtgctaggtattttggaatgtcatttatttaatgtttaccatggcagaaggtagattttattctattagcttacagataaggaaactgaggctcagatatgttgaataacttgtctagagaagaaatggggattatatttaattattttaacaaattccatgattgtcagttacctcctgttgcttttttttttgagacagagtctcgcactgttgcccgggctggagtggagtggcacaatcttggctcactgcaacctctgcctcccgggttcaagtgattctcctgacccagcctcctgagtagctgggattacaggcatgggccaccacactctgctaattttctattttaaatagagatggggtttcaccatgttggtcaggctggtctcaaactcctgacctcaggtgatccacccaccttggcccccaaagtgctgggattacaggcatgagccactgcacccggccccatattgcctcttaaaaggtgtgctatcagcatgaggctgttgaaagataataaggtagccagtgagcaccctaggaggaaggtgactagtacgttggcagtcagcctcttgaaatcttgtagagtacagacagaaccaagagttgagacagccatgtctcccccacattttaagaccattctctttctagaactcactcactgccttctggttgctttaggactcccagtacccacccagacagccccagctccagcctctggagacatctccttagtgggttctctgcatgcccttccatccttgggaaaacccagaacaaaaccagatcttccaacagaggctctgcaatggaaaaatcccaggggactgaggtgcatgatctgctttggagcactcagggatatctgtctcctcacactgggctggttgtggtgaagggtgcaccgggctcttttaatgtacacatctggattgaactgagattcccacagcagatttcctaatggtgagtggaggacaacagataaataaatataattaggaacagtatccagactgacgcatgctgaagagtttcagcaggtaccaacagatatattcaggagtcagagaagcttgggaaattcccatagtcataaattgtaatctccgggtcaagttagctgaccatcagaaatcatcctggcaggtcttttaacactgcagtttcctgagcctgacttctgaggattctgattccataggcctgtggtgtatttgtcattttgagaagcctccagggggattctgacaactggccaaacttagagagattcacaaggcacattgtcacattaaaggcactgaaaagtcctgtaataatgacacccacatcatttcactgaaccagtttatcaaagttacttgaacacagatctctccctctatatattttgtacacctgtttttacaaggtctactgctcagggagcttgccaagatttcctcttaataattctatactaatatcataaatccaggtttttttatgtctttcctaccattttgtagtatccactggctgttctctccttgaaggcaggaatagtgtctgttttatttgcaatatcccttatgcagagtctgagtaaatgagtcttttaagataatctctgaacaggggatgtggccctctgcctccccggttcaatgaagtactttgataccagggtggaagagagatttaaagcagcatgtcatagtaggaaaggctgcagagccacttttggttgacagtcatggatgatgagtgccagcagtccagctccttctcctctgagctgtttctccactgctctgagatcaacctcttaacaaacttggtccccaggtaaaagccctcctgagacatttggttaagaagaggagtttcccatttctccccttctcctttcagccaccaggcattgaagggagcagtgctgaggccatttaaatgggcttctccatagaatgggcccttctgttggaaactgggttatgcacaaaccattcacaatggctttttacaccccagaagcactaagatccccctaatcttcagtcaaaacagagcatgaagggtggggtattcatcccaaaggcactgggcatctgaaagttagggaggggtgggaccacccacattcagggctttgattttccagccagaatgacaagaccacaagacccccaggaggactccatccttctcattctttatgtggtggacccttaaaaagtgcaaggtgggaggctgaggcaggcggctcatgagatcagaagatcgagaccatcctggccaacatggtgaaaccccatctctactaaaaacacaaaaattagccgggtgtggtggcacacgcctgtaatcccagctacttgggaggctgaggcagtagaatggcatgaacttgggaggcagagattccagtgagctgagatcgtgccattgcactccagcccaagactcagtctcaaaataaataaataaataaataaataaataaataaataaaataaataataaattaaaagtgcaaggcttttttttttttttttttttttgtgacagagtttcgctcttgttgcccaggctggagtgcaatggtatgatctcggctcactgcaacgactgcctccctggttcaagcgattctcctgcctcagtctcctgagcagctgagattacaggcgttcgccaccacgtctggctaattttgtgtttttagtagagacgaggtttcaccatgtcggccaggctggtcttgaactcctgaccactggtgatccgcccacctcggcttcccaaagtgttgggattacggggtgagccaccgtgctggccacaaggcatcctaacaagagttttgctaccattatctcccgttacagttgaggaaactgaggcatgcagaggttaaatgaagcacccatcagagccaagcagttagatggcaaagttgtattagtctgatttaagaaaagtttaatacaggtaccatttacagaggtgcagacagtgtattgatttttttttcttttctttttttttttttttttttgagacggagtctcaccctgtcgcccaggctggagtgctgtggctcgatctcggctcactgcaatctccagctcccaggttcaagcgatcctcctgcctcagcctcctgagtagctgggattacaggtgcctgccaccacacctggctgatttagtaaagatggggtttcaccatgttggccaggctggtctcgaactcctggcctcaggtgatccgcctgcctcggcctcccaaagtgctgggattataggcatgagccactgcgcccgacagtatattggttttctatttctccataataaataactacaaacttagtgactttaaacaacacccctccattaggtcatagttctgtaagttaacaggccaggtatggcctgattgtctcctcagtgtgtcacaagtttaaagtcaaggtgttgctgaggctgtgatctcatctgaggctcagggttctctttcagactttttccagttgttggcagaattcagttagttgtggttgtaggactgaagcccccacttccttgctggttgttgtccaggaaccacttttatcttttagagaccacactcaaagtccacaggcaattcacagcatggatgtttgctccttcaaggccagcaggtggctgtctctcactcttcaactctctttgacttctaagggtcacctgattaggccaggcccacccaggataatcttccttttgattaactcaaagtcaacctaataacagtgtgaaatgccatcatatttgcaagtccagcccatcctcaaggggagggcattatgcagggggtgttcaccaggggagcaacaatcttggcagccagtttagtattctgcaatgcagagacaggaagcaggaaaccaccaggaatactgcagctccctgggaagagcagtggcgggacttgattacaagccctagtcatgaatagatgaggagctgagagacacagaaggctgtggggagagggccaccaggaagatgctgggtcctttggttgaaggacacagctagtccatagttacttggcaaggagggagctagaaaaataaatagcctgacctcagtttcctttcttttttctttctttccctccttctttctttttttctttttttttttttgagacagagttttgctcttgttgcccaggctggagtgcaacggcgtgatcttggctcactgcaacctccacctcctggtaaaagggattctcctgcctcagcctcccaagttgctgggattacaggtgcccaccgccatgcctggctaatgttttgtatttttggtagagacggttttgccatgttggccaagcttatcttgaactcctgacctcaggtaatctacccgcctcggcctcccaaagtgctgggattacaggcatgagccactgcgcccggccttctcactttcttttttgagatggagtctcactctgccacccaggcttgagtgcaatggcgaggtctcggctcactgtaacctccacctgggttcaagcgattctcctgcctcagcatcctgagtagctgggactacaggtgtgtgccaccacacccagctaatttttgtagttttagtagagacaggggtttcactatgttggccaagctgctctcgaactcctgacctcatgatccgtatgcctcagcctctcaaagagatggcaaagatcccaaagattacaggtgtgagccaccgttcccggccactttctcactttcatcttctgttgttgctctcctttggctgatcttaacatgaagctgagtaagggagccagcttattgatgcagtcagtagaagccagcttcccagggagatccaggttgggggaatatggagtgtggatcaggagaggtaaggagatgatatttggcaaaagtacttcttagagtcacacatcttgtaatgatagacctcagattcaaattcaagtctgtttaaagtcaaattataccatctatgcatccttccatgcatccatccatgcatccatccatctatccatccatccattcttccatttcctgagtgcctactgtgtggcaggcattctgctaacctaacaacccagtgagagacatacttatattcctattttataaaggcccagagaggttaagtaaataatccagagtcacacagccagggagtggcaaagctagaattcttatttaattccaaacttgatttctaccctctccaccaccaaccacccatatatatccactgaccaacctattcattcatcagacttttactgcatgtctcaagtaagctatgcactgtgtttagagctgaatgagacaccattcttatgtctccatgatattcacagtctggtaggagaaacagacctgtatacaggttattgtgcagtggtcggggacaggaactttgagagaggaacgtatggtgcccacttgtgggcatataggagtgagaggtctgctcagctggggaaagacagcatccttttgaggtgggttttgaaggatgcataagattttaaggggacagtgcatcttggaagggcatcatatctttgtagtccagctgcctctcctttgctcgagcttccttccttccttcaggggttaatttggaaggactgagttttgctgttattgagcaaacagagtcctctaaagtgcatagcccaggggctggaatggagctcacgatgtatgtgtgggggagaaaaactactttgatttgaattcctgtctggctatttttgagatgttatatatgaccttatgagggcccttccctatgtggtcatgtctataagagatttcgtatctttacccactggtgtcaggttggctgggtgactttcagccaatgggatatgagtggaggtggtatgtgctaattctgggcagacccattaagggcccttctgtggtcaccctttggtctccctttttgtgatactatggatagtctttatttattattctccaagggttgtgcctcaccttccctttttactgctgccccaagaccatcaggtttccacaagggggttgcttctttagccttaatcctggaatgaagtgatgagggtcagagccagagctgagctgcaagtgtgtgtcacattccagaggaaggaatggttgttactctaagacatggacttttgaggtcatctgttatcatagcatagtgtagcctaagctgaccacagcaaggcatctcacctttcgacatgttagtttgctcatccatagaagtggattaatagttgtagtcgcatggcaaaaacccatccctacaaaaaaaaaaaaaaattagccaggcatggtggtgcacgactgtagttccagctactcagggggctgaggcgggaggatcatctgggcctagggaagttgaggctgcagtgagctgtgatcacaccactgtactccagcctgggtgacagagtgagatcctgtttcaagaaaaaaacatatctgtagtcatgttattgggttttgtgaaaattaggtgaaattgctcagtaaaagcacagtttctagcccaatgtgtgtctgcactttgcagatgttcaagactcttcttccagtccctttctctgtcatacttatttctccccagggcctttgcatgtccatgctcttcctttgcctgaggctttttctcatttccttctttactcaagatcccatatgcagacctagctcccccagggggccagataaggatgggcttagagccccagaaaagtcaggacaggaaagggatgagaaaggttgcacttcagcaaccagaatcaggaaatctagaagagagttcctttaacctcaacatgtgcatatattttgtgctttatggttttgcattcttttaattttgatttacatcgggtatcttggctgggcgtggtgactcatgcctgtaatcccagcactttgggaggccaaggcaggtgaatcacttgaggtcaagaatttgagctcagcctggccaacatggtgaaaccccatctctactaaaaatacaaaacttagccaggcgtagtggtgggcgcctgtaatcccagctacttgggaggctgaggcaccagaatcacttgaacctgggagggcggaggttgcggtgctgagatcatgccactacactccagactgggcgacagagtgagactctgtctcaaaaaaaaaaaaaaaaaagtgacataattaaaagagccatcatctatggcctttaagtgtcatgtgtgtgctcatctttccttgctttactactcaaagattatcttttccatgtgacctgctctttcctgcctctgtcaccaccaaacatcaaagccttaagttttgtttggctgtttgttatctcttgagaattgagcaccagagctattgggtgggcttgatgttgacctacaatgcaggatgtctgtgggcatgactctctcctaggcactcacagacacttgaagctggggactgaggtcctctagtgtgtgtctgtgggggtgaaggagtgcaccctcatcctcctgcactttcgggtcttgtagcagcaactccctgtttctgtcctttctacttactgctggtttcatcacactcccagggttaatttaaagaaccagcctcggtgtgatgcacctacaacaaacagagccacttctgtggggagctctggagctgggatggcccctcagagtctagaggtggtgagagcgctggagcttcatcaccgtgctaactgtgtccctggaagagtgagggagcttgagtgattccttacccaagggccgtcataaaaggtctcagctgatgcctactgccgatcacattcagctatttgggaagagatgttcagtccttaagaggacattattagtggacatcactctttccacaaaagccccagtcttgtgttacttagtcccactagcttctttaaagaaaccccaagagcatttcctccaggaatctgtttgatctcttttcctgggggagatttccaggtgattctcattggaatgaatcctaggtcctgttgctgctgctggtctcacactgtgactgatgctaagtccttctcttccaccaccattctggattttccttgctatagcctaagtgtttatgtctccccaaattgtcagcgttggagcaccaagaagacaggcagcactgacagtagcagaagagtaggaggtggctgtggcaccccacgccgagcaggagcgggaggagttcctgggcgatggggccgcagcctgggccgatgctgaccatgggatgagatcattcttcactctgcaccgtgaccatcagggggcgccccaaccaccttttctgccccacatcgtgctcttgcagtgttctccccgcaggtgctgcatggagtgagtggcggcatccaccgtgaggaggagaggagctctgataccctcaggacccgccaggaggggcatcacggaggcttctggacgacttggagctgtgtcctggggagaaaaccgctcctgtctgggccctgagtgctgaggaggaagctgccatgcacttttccctggcatttttcctgcatggtgagtacagaagctttagttttctggtatgttctgttcattcctctcctgttctccctggttttcctctttctcttgtagtgttttagtatttattttacagtggtattcattctctgaaggcttttgagggtgtcaagtgtagcagactgtggtatttttaggggtttaagactttttctgggtgggggggaggggggagggatagcattaggagatatacctgatgctaaatgacgagttgatgggtgcagcacaccaacatggcacatgtatacatatgtaacaaacctgcatgttgtgcacatgtaccctaaaactttaaagtataataataataaaaaaatcttggtttttattaaaaataaataaataaataaatacatttctagttctgaaaaaaaaaaaaaaaaccaaaccaacaacagaaaaagactttttctgagggaacctcccctgtgtagagggagagagagggaagccccgctcaggttggagtcagggccaggcccagttctggctggctgcctcgtgtccaagcctcagagggaggatttgcattgggccttgctgcatttttaaatcttcgttcctgccatcaggacccaggggtcactcttcttcacttttgggcagcgcgtgtcctctcgtgtccctcccaccgtggccgcctgaccaggggcgagggactcctcggtgtgggttttttgtcctctttgcagaaatgtctgttctgggcctctgcccagtttggggtggattattttttgttgttgttttaaattgctatttagtactgttaatgtgttgtatattttcggtaagaaccccttagcagttatatgattcctcaaaactttcgtccaaacttcgggctcattttttccgttgtggcacagaagcttttcagtttcttgtagcctcacatggttgttcttgctttccttgcttgtgattttggtccccaatttaaaaaaatcattcacaaaccattccattctccatgaggtttttaccccttatgtattcctctttttctttttgaaactctttccaactgatgagcatggattcaagttgtcctgaaagtaagctccccctatcttttcttacaggaatttaataatgttttgtggtttcaggttttgtgttgaaatctttaatccattttgagttgatttttgtgtatcgtgtaacagaagggtcctatttcttttcttttcttttttgcatatggatatcagtttcctcaaaatgatttcatgaagaaactctcctgtccccattgtgtctttctgatctctggtgccgatttcatttgctctggagttatacccagtagtgggattgctagatcttacagtatttgcattttctgtcattttctttgagacggggtttcttctgtcacccaggctggagtgcagtggtgcaatcacagctcactgtggcctctacctccacagcccaagcagccctcccacctcagtctatggtagctgagaccacaggcacacaccaccatgcctggctaagtttttaaattttttgtagagacagggttttgccatgttgcccaggctggtctcgaactcctgagctcaagtaatctgcccacattgaccttctggtaattgtattttcagttttttgaaaatggcaacttccaactttttaccatagaatatgtactaatttatcttcccatcaacagggtataagagttcccttttctccaaatccataccagcattctttttaaaattttgtggccaggaacagtggctcatgcctgtaatcccagcactttgggaggatgaggcatggtggtgtgcacctgtagtcccagatacttgagaggctgaagtgggatgatcacctgagctagggaggtcaaagctgcagtgagctgggatcacgacactgcacttcagcctgggtgacaaagtctgagtccctgtctcaaaaaattaaaaaaaaactttttagtaacatttatttcaataaaagtgaaacggcatctgaatgtggttttgaggtacattttttttctgatgagagacgttgaggaccgtttctcttacatgttggtcaattttgtgtcatctttgcagagatgtctactcaagttctttgtattggtttggatatgtattttgctacattgtattttttttctgtgtatatgtttgataacaaccagtgattgagttatcgcttacatgattccctttctttttttttttttgagacagagtctcattctctcacccaggctggagagcacagtagcacatcacatgaccatatatattggctacctacagctttgcaatgtaatttgctatcaggaattgtgagtctcccaacttagtttgtatttctcaggattccttagaggttcagggccattagtggttctatgtgaatattagcattttatattcatatttcttaaatttttgccatgtataataacatacacaattagaagttatgctgggacatgtttttttctttggggacattttgatacatgtatactttgagtaatgatcaaatcagggtacttatcataactattccctcattgaggtattatttctttgttgtgagtacattcaaattgctcccttctagttttttgaaaaatacaatattttgttaaccagagttacccagctgtggcatagaaaaccaaaatgtgtttcgccaaactcactgtaactttgtttccataaccgatccctcccatccccctcctatccccctccttcccctctcctcaggaaaccgctactgtaccttctgcttgaaggtaaagttttttggattccatataagtgagatcacatagtgtttgcctttctctacctagtcgatttcatttaatgtaatgtcttccaggttcgtctgtgtttttgcaaatgacatgttgtcatgaatttttatgcatgaggcatatttcatcatgtctgtatgctgaagtcccttcatcctttcattggttggtggacaggtaggttgatttcataccttggttactcattgttagtgagtagtaggtcactaaacctcagaaggcagctgttgcttcaacagaccgatctcattttctttaagctcacaaccacggttagaattactagatgaaacagttcttgcatttttaatttctgagggtgctccaagtggttttctcagtgcgtttcatcattgaaatttctcccaatagtgtataagaggatctctatatctaacagcaccctgaacttttatttttaaattatttctgttttggtattattcattttacttagcgttagatagtatctgagtgtggtctttatttacagttttgtgatgaccagtgatgttgagaaacaccttttttaccttttaatcaatatcataccttcttttcagaaatgtctgttattcaggtttttttgcccagtttttttgggggtattgggtcttgtatgttttgtccctctgtagcgttagtttctgctgttgtcagataacactccctttcagatatatgattcctcataatttcctttttttgatgtgtaaaaagataaacctattgtggcaacagccaagaacggtaataatcaaatgcaggaattaggtgccatttatatttccccactcagagtataagacttcctgcctcacagaagtaaatgagatttttctgtgcatatagtaaaattttacttttcatattttaatttttcgtgtcctaaaaagttaacacaatttaattaaaaattaaagccactaaaacatttatgtaacaatttctttttaaattttactttaagtcctgggatacatgtgcagaatgtgcaggtttgttacataggtatacatgtgccatggtggtttgctgcatctatcaacccgtcatctaggtttcaagcctggtatgcattaggtatgtgccctaatgctctccctccccttgcccccaaccccctgacatgccatggtgtgtgatgttcccctctctgtgtccatgtgttctcattgtaacaatttctttaattaccacataaggtactatgttatctgacaaatctatgttttacagagaaattgtagaaaagtcattcacaagtttcttcttgatttcaaactgtaacacaatgttgtaagtaatgcaactagacagaattcggctggatattgaaattcaacataataaaaaatatatatgctggtttatccatactactcacactgttagtatgaatgctctatcctaaagacagaaacaagtgtcttagtgaatctatatcattacaaactagattagcttttctccttttgaattttagaaaaatacaaaaattcaattgcctaattattgtacacagtgtttcaatatatgcatgactaaagcaattataggatttttttttttttttttttttgagacagaatcttgctctgtcacccaggcctgagtgcaggggcgcgatcttgactcactgcaacctccacctcctggctttaagcgattctcctgcctcagcctcccgagtagctgggactacaggcacacacaccacacccagcttattttggtatttttagtagagacagggtttcaccatgttgcccaggctggtctcgaactcctgacctcagatgatccacccacctcggcctcccaaagtgctgggattacaggtgtgagccaccatgcctggccacaattatagtttttatataggagtaagaaaggtcttaaatggaaagattaaaaaggattgcaaatcacatggcagcagaagggagctataattataacatgtcagcaagaaaaccaaaaatcacctttcaaatctagaggattatggaaagatatctgaaaaaattgtacacttctgataaaggcagtttattttacacaaaatgcttaccaataatgtgcatgaggaaaaagtgaactcagaagttgacaagggaattcaaagagggaagaagaatttttgtaccaaatgctgcttgaataacaaaatataaatatttgcatcccattctcactccatacggaaaacaaatgggtacttctttctaaccttggaacaggtagaagtttcttgtaaggacacagaaagctctaaccctacataaagacatttataggttaaacttcagtgaaaattaaaggttatcaaaagacactataaacatgaatatgcaagccacagacttggggaaatatatgtaatacatgcatttgtcaaataattcatctcatataaagaacttttacaagttaacaatacagaggcaaacaggccaattaaaaagtagaaaaacttgaacagacagtttgcaaagcaagacatacaaatagccagtgggtatattaaacaatggtcaacatcactaacagtcaggaagatgcaagttaaaatctcaagatacaatttcatttgatttcacattttagccactgtaatggcaaaatcaaaacgactgataatactaaatgttgatgaaaataagaattaaccaacactctcataaaactggtggaattgtaaaacaactactttggaaatggtgtagcaatttcttgtaatattaaatatacacttaacctatgactcagcacttttactccaagctgttgatccaagaaaaataaaaatgtacattttagtacattttttagtacatttagtacattttttctagtacaagtctatgtgtgtatgtatgtgtatgtatgtgtatgtatacacacgtacacctacgtagacttgtactagaatctaacatagcagtcttatttacgttaacccaaacttggaaatgagccaatgtcctttgacagtgaataaataaataaaccatggtgtatcacacaacagtatatattcagtgattaaaagagaactatagaatcgcacaacagcatgggtgaatctcaaaacagaaaaatgtatttagagaaggaagccagacattgaaaagtgtggatgtgtgattccatttatttgaaatgcagccataagaaaaatttatctttggtgacagagctcagaaggtagttgtttttgacccatgaaggtactgactggaaagagatgtgagaggattttctggaaatgttctatattttgactgggatagtaacatgagggtctataactgtcaaagctcacagaagtgaacatttaaaacttctgcattttacaaagtataaattgttccataatttaaaacaataaacagtctcatatcattcattccttcaacaagtaattatacaggccttgccttttagtagttctgcagccttgtgaagatttgaagatttcttaacctctctgagatcatctagctcaagccaaatgggataatcataaaaaccacctcaccagggtattgaaaaaattagttataaaatgtttaggtcagtgtgaggcacatactagatcctcagtaaacattaactgattctatatttaccattcagcacccagacttgagaaaggggcaaggcaaagaggaagctc

SEQ ID NO: 262 - DNA, 9097 bp, Homo sapiens
aggatctgaccttggggactacagagaggacagttgcctcactctggaggactggaggagtgggcagcagctcaggtcccagtcagagaacccacaacaagcctccccaacccctggattagggcccatatgggccctcacaggcatgtggcaggtacccgcactgggcaggagggacccggtcacactgcagatttcccaaagtagccccacggctgcaaggctgctgtccagcccgcctggtgtgggggagtccaggctcagggaggacacagcagtaccgcctgcttgggctggcagggagctcaagtcagcatggggttcaggccccgcctgcctgatgggcgaacacacccccaaggcccccgttagggccaggaggcaggctggcagccagcgcaggtgcagaggggccccgaggcttccatcctgaggtcagcactgggaggacagaggctgcctccttgcagcccgagggttgaccaatggcactcgccgcatcccttcccagagcaggccagccccacgggcatcatgagggcctgcgtttggtttaatgctccgctgtcaacatcttgaaattctctgtaatttttaaataaggggcccgcagtttcattttgcacagactatgtagccagccttccccagaaggctcgtggagagctccacaggccctgcctctccctgggggagctgctcacctgcctgtgcccatcttgttgggccgaccctgccttaggggcctgtggtcctggctgaatggcgttgcattggaggccaggcacatgtttgagtgctgcctgtgtgccaggcagggctggggagggtggaaggaagcctgggggctgagccactgggcagggacagggagagccctcccagcagagggaggtgtggccgcagctgtgtcctcaccctggtgtctacctccacgggctgggccctggacaagaggaagggtaacttgggctcccagccccgccgaggatggctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccc

SEQ ID NO: 263 - DNA, 13508 bp, Homo sapiens
ctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatcagctctgtctaccaatgtggtcccctggaccggacagggccctgggttggggaggtgacaggacctgggcagggagggtggtggccaggaagggaggggagttgcatgaggggcatgaggtcagtggatcagcaggttcagcgctgaaaacctgacctctgaggtccctgggagggcctggcccagggggcaagacctgaggaccccccagtccttactgctgttgcctttcagtggagaccctcctaagacgccttggggggtcagagccccgtgcagaggggctgccttctggagggcaggtaggatgtggggtgggaagccggccctgagctggggtctccaccctgagggaccctcgctgcaggatcgcctgggcatccctcccccaatttccacagagacgtgctcaccggccacttatgtcatgattctatgtccagccacaggcccagccctcaggacagaccccacctccacccttctctgcagcttctggcaaggatggtgcacagtggtgccatgtgcagggggctggcacggccactgggcatccggggcagtgctggtcgcctggcctccttgctggggccgctgggcctctggcctagaagggcaggaagccgtccactttgaggcgcaggaaggggtccagcagggcccggagcttccagacggtggcacggctcagcaggggtggcaccagcccctcgaaaggtgtggggttcaccacgtacacgtaggcagcggtccagaccagcagggcgcccagcagcagcctcagggtcagcagcctgcgggcggcggtggtcaggggcaggggcgcgcggggggcctgggggctgggctctgccgtgcagtcacctaccagagctggcctgccaggcccttggagcttcccagctttggcctccctttctgtcggggaggggctggatcagagcccaccccgagtgtccaggctgagggcagggatccctggctttgggaaaccctcctcagacagggctccccgcaccgcagccctggccccttcctcctggacaggctcctgcagccacttttccgatgccccctgccctggacctgccctcctggagcccatttctccctctcgcccaagcagggccctgggtggggggctggtctccagacccagagtggggcgtggggggctcaccgacatgcttgccatctgcttctccttcctggctcgagtgcggcactgggcccgctccctgcgggggcctcactgtcaggaccccacaccctccacccccagcctggcacccaccccctggctcggtgctgtggaggtggggggtcaaggatgggtctgccctgtcctgaccaggacaccttctgagaccctgctcagctggcccggcccctgcccccgtgttacctgagaatctccagctggatgtcctccatctggtccagcacgccccggatgtccttcttgaggttctgggggccagaggaggtaagcacagcaggcccctcgccccgccctccgtggcctctcgcccgccgggccccgtccttctgggtgctgccctgtggggacctaccaggagcccggtggcctggttgttcagggccatgtgcatctcagccacgttgtcccacacctagggggaggtggggtcacgcctgaggagcaggacccactgggtgggcccccagcacccctccccctcagccaggcgggcacctctgtgatgaccatcttcttcctctcaaagcacaggcggatctgctgcagctcgttctgagggtggggcccaggatgggcttgggcagcatcagcagggtggccagtacctccccgctgggcccactggcctactgcacgaagacctccctccctaatgaatccctcaggcccacctggagtgctgttacgaagcttcctccccccccacagcccctcccccaggcccacctgggactgttgcacgaaagcctcttgcccctggcacagctcccgccgcagcagctgcagaggtgccctgttccccaagggctgcgtgccagccgggtcggggggctgtgggagagcccccagatcagccctaagactgcgggctagaggggcgttggctgcatggggtccctgggccctgtatttacccaggccagagcagtgcagcttgagtgttcgggacacaggggcaggaactgctgccccggccccaggagggcccccagctgctcccgaagttcctgattctgccttttctggggtggggggcagagagagggggctgcctgtcatggccgctcctgcggctggggctggggcaggggcaggggcgccaggtggtgggtggggctggggctggggcaggggcaggggcaggggcgccaggtggtgggtggggctggggctggggcaggggtaccaggcggtgggtggggctggggctggggctggggcggtgggtggggtgctcaccaggctgtggttctcctgctccagctgcaggaaggactgttctgcagagcccagcagcccgcactgaagctgggacagggctaccctgggcgaggccagggcccctccctcccgtgacaggggtgggcatgggcagggtctggtccctgagccaatggatcccccctgcctgggagccccctggttcgaccctgggtgcaggggccagccccacccaagccctgcctccaggtctccttgtctcggcccctcagtgtctctcgctctctgctcctggctggacagaaagagcccgggagcctcgccctccactgtgggcccactgccccctgcccctgggactgggaaaggtctctgggactgcactgagtgagcagaggagatggggcccaggcagggccaccctacaaatccctggcagggctggtccaggcctcctccatggctgctggaggctggggttgggggacactgggggtgggggtggccgcaggggcccagggttttcagcccctccatccctccctgcaaccccttcctgatcccaggtccaggctctggcctggcccaacctgccaccctcttactgagggggctgccccaggcaacagtcacaaaggcctgggtgcagccagggcggtcacaatgggcccctcccacctggtcctgaagctgccccgcctgatgacctcactgcctctgacccactgacccaccatgcgagttttctttctttctttcttttatgggaaggggacttgctctgtcacccaggctggagtgcagtggcacaaggtgtctcattgcagcctccaactcctgggctcaggcaatcctcccacctcagcctcccaagtagctaggactacagatgtgtgcaaccatgcccggctaatttttaagttttttgtagagataagggtctcgctatgttgcccaggctggtcacaaactcctggcctcaagcgatcctcttacctcaatatctgaaagtgttgggattacggatgtgagccactgcacccagcct

SEQ ID NO: 264 - DNA, 751 bp, Homo sapiens
tcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctac

SEQ ID NO: 265 - DNA, 775438 bp, Homo sapiens
  misc_feature (419967)..(469966): n is a, c, g, or t
atgggttttatagattccatccatcatttgagtcattctgctgtattgtcttctaaaccgtcatcaaccagtgcatctctgggggctaaggccaaatccagcagcaaccccatcagcttgccaactccccagaatccccccaaggaggccgaccaggcccattcaggtatgcaacagccaatggggcagaagcttcatctcctctttgatttttcttcaaggacagaggtttggactgttaggggcgtaaattcatcaaaacctagacagaatcaagaaaccaccctcattcaccaattgtgtctgatttaagaaaatattttagaaaataagtaatccacatcaggttttgatccgcacaccagctttgaccagtagttggctgaccatttaaaaagaaacatttttattggttttctctcattttatcctgggaggaaagaggaaaaatgtttctcccaggattacaacagccataggatgaaaagaaattcacatctactgatccactgtatgtgttacccattaaatctgcatggagatcctccccaagagacagtgctacttatttcatagccaaggacgctgagaacagcctcagacaaggttctgttcatagtacattaccattaatggatgtatgaatggattggcagtccttgatatgtacgtagtgcatatcttgggggcagttaaaagggtgcatttcatttacaagtccagcttagttgccagagggtacactgctcattcacagccctgtaccaggggtggcaaggaaaaggcaaaccttgtcttcacctcctacctcccaccatagctggctggctgccttcagtatggtttgttgtgaggtttgacttgagtagaggtgctcccagaaagcacagtgctttcttctgctgccctcatttccctgaaggcaattcaaccaaaatcttaaagaagaggaagtgttccaatgcttcctgagcctggtttcaaagtttctaggccagagtgggcagcagctggaccagaatcatgaagtaaagctttgcttccagaattgtagacatctgcttaaatgttttgggttcaaacagagcagaagatgaagaatggaggatttaaaaatcagaatgcctcctcaaagaatgtctgggctgtgttacctggcaatttgagtgtatttgcagttttgatctgaaatggtgtcagcactgttgggttgtgttttaggacgtaatcattgtcttctacattagacattctctatgggtcagccttggtttctgccccccaccattggctacctgccctttaattgcttttagggaagaggaaacaattttaaacattgaaacttgacagggcttctaaagatctatctgacagagtaaccaaggaagaagagtctgctgtgatcttctcactctccccacaatggctcaccttgtgccccacagcatgtacatgcccatggaggccagggtgacagaggtaacttgtagagtcaggagcagagcaaagatcctgatccactggtgcttgtgcatggcacttggacccacaaggtctctaaaaacttgtctgtaggtgggctgcctaaagatcaccagggaagactttttttaatacaaatttcctgttccaagaatttataattctgtaagtctacattaatgcctagacagaatcaagaaggcctaaagaatctacatatattaagagtttttgctatgtgatttaaatgcccagaagggtttgcaagccattttgtctaagccactctaccaaggcatctatttttaatttggtgattgaacacgttgatttggaattctgaagtttgtttccatcagagtcctcaactgcatgcactagtaatgaaaatttccccacagcctttgttcatctctctcctactcaggatgggacctgatgccatcagagaggagttctaggtggagaaagagtcttgtcccaaggccaaggactgatacatgctgggagcagagccccaggggcccttgagagcattcaggctctctgacttttccatgcccaggattgctggcgtggggctcaataatgccaccttaccttgtttagccaattgctttcaagatgaacacagaggttgtatgcaggatagccctggcaggggaaaagagggaaggtcagccaggccagattctctggtagcaatggtcactcttggctgtctcatcctgtaccacactaggtaatagccactctgcagggtgatgtctggttctcaatcttttgctcattcttttctctcattttgatgatgtgtctcttttctccctaactttctgtttctaggcattttcactccatacccaagctgactagacttcctcaggcaccattgccctcagctccatccagtttcctgcctttcaggcccactggccctcccctccttggctgctgtgagacaccggtggtctccttggctgaggctcagcaggagctgcagatgctgcagaagcagttgggagaaagtgagcacttctgcatttgtgtgcttgtgaatggcagccccacactgtgttgctctgcatggatcgggctggatggcagagttcaaagaaacaatatggggacatgttacaaatggaagactgagggaaagctctgcttgcttattttttggaaatgtatttcctgttatttctctgatgtgtgtctcatcagttaacaggtagatatgttcaagaggctctagacctggtgctttcacactgtagatagtgtaggataccaccaagtatgctgaatccctgacagactggtggactgctcattggtaggggatgggaggagatgttatgctttgcctatgcaggatgaagtggccaagaaaaagagggccacattcagtgggctcctttgtgtggctattacacttttctgctgtgaaatgctgttaatcaagttcagttcctgacatcattaggttggagcaaaaagggtaatggtaccaaagtgtcagctatggcatctgactgtgaatcctatcttctgactcccaaagataattgaccttatatagttatgtagactgtggacagtcaccttttagaaaatgctagatatatttgtaggctggatgctcatcataaatttagtatgctggtggtcattgatagcttaaaaaaaaagacaaaccttcacatgaatttgctctctcgtagcaccttaagcacaacagttagaaagcagtttgaatgaacttaaactcatttgtcaggcactttctgtgcctgcaaagaagcttaggtgagccagagactgatagggtcaccatgccagcagtttctagtgaagcaagacaacagccaagaatttgcatccccctccctgtagccctaaatgtcatgtggaccaacctatttctttccttcttcctttctttttttttttttttttttttttttttgagacagggtctcactttgtcacccagactgaagtgcagcggcatgatctcggctcattgcagccttgacctcctgggctcaagtgactctcccacttcagccccccaagtagctgggattacaggtgtgtgtcaccatgcctggctaatttttgtattttttgtagagatggggttttgccatgttgccaagactggtctagagctcctgagctcaagtgatcggcccacctcagtttccaaaagtgctgggattacagacatgagccactgcacccagcctagcctatttattttgtcaacccagcaaatggatactttgtctagtgcagggaactctaaagctcagggaagtgaagttacttgttcaaggtcactaggtgggagagatgggcttgaatctggtcttccgctccaggtttcacgtttctgttataccttttctgcttaggatggctttgtcaccatcctgcttagagtatggggctgagatcagctgatcaaactctggggaatccttgcaacaatttttttcctctctttagagaccagtaggaggtgctggtgtttctgacccaaaacttgttactttagcagttgtggcaccagcaatgggtgggcaaaaatgtcccccaagacaaatggcaagagtattttctagtttccatttcttcctcttgcctccttttcctttatctatccacatttgtccatttgtctttgcccaaagggaaggatggaaggagagcactgtccatgaaaaagggtctattgttttgggttaaattggaattacgtcaagtctgaggtcattgactggagatcaaatggtcccagcctagatgaggaagattgtagccctttctttctccacctgaagtcaaggtcctctccaagggccattgcttatccaagctcactgtttgcgttgagccaattttccgtgtggacagtggtgcatggcggcctctcaggtccctgggttaaaatcttgtgcaagagtctgtatggtatctttgcatggtttagagcatgtactgtgtattgtgtggccaatggactggaacatgagaatactgatcattgttactgatagacttaaaacctcacatggccttgattaaaaagtaagctgactatctacaaccactgatttctccctttgccttgtgtttggatggggttgaaggcagtttgaaagaggcaggaaatcacgtatttgttgcatcccttcaaaaatgtaggtgcttaaatttttaatcttcttccttaactaagtgatcctgatgaatatctagtattttgcaaattggaggagagactcatcacaagacttctcaaacttctgcctgttagaatcacctcagtatatgtttccatactttctcagatgattccaatatgtaccaacatttgagaaccagctacaaatggggctaaaagctggcaactggcaattacactaacccctccgaggagtttggcttggttggaagaaacaatgacctcactcctgttgcttaggaggagctacctgtctattctgctgcccatgttcataatccctgaaagaaagcaggcttctgaattttctcctaaattgcacttctgcccacctctttccctatctcctctatgctgggcttctttttacagagaagtggagatgaaggggctcaagggaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcatcattcttgtacacttctcattggccactggtgtatttctatagggtggaggcctggagagcagttgttccagcatagtgtttacatagcttttatttaattccgttttctttcctttgttgctttattagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttgatcgccaacgtagatcggaactcggttcaccagcgacctgaggacccggcccagaagagggagtgtctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtacgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaatggtacctggttttggccatgctttgagcctttattcattctgttaacttgagacggtatataagcctctgcatcccattgtgtgtttcactcacgtccatgtgaagagaccaccaaacaggctttgtttgagcaacaaggctgtttatttcacctgggtgcaggcgggctgagtctgaaaagagtcagggaagggaaataggggtggggccattttataggatttaggtagataaaggaaaattacagtcaaagggggctcttctatggcgggcagggatgggttcacaaggtgctcagtgggggagctttctgagccaggatgagccaggagaaggaatttcacaaggcaatgtcatcagttaaggcaaggaccagccattttcacttcttttgttgtggaatgtcatcagaacaggccatttaaatttcacttcttttgtgattcttcagttatttcaggccatcttgatgtctacttgcaggtcacaggggatataatggcttagcttggtctcagaggcttgacattcctgtcttcttatattaataagaaaaataaaacaaaatagtgttgaagtgttggggcgatgaaaatttttggggatggtatggagtgataatggacgatgtttctcagggccactttgagcgggattaggggaggtgtgggaacctagagcgggagaggttaagctgaaggaagattttgtggtaaggggtgatattgtggggttgttagaaggagtatttgtcatatagaattattggtgatggcctggatacggttttgtatgaattgaaaaaagaacggaataagacaaggagaaaaacaggtattaaaggactaagaattgggaggacccaggacatccaattagagagtgcccaagggggttcagcatagccctgccatcaaagattatttatttactttaagagggagttaagagtggcaaatctggggacagcaccaggagatataagctgtgatggcttggagaaacagagtaaaccgccagtttaaacaagagcagagcatttatgagtagttgagaacggtgaatagaagtatgactagacagaagatagtagtgatgacaagtttttgggggcacagtccaagttggtctggtgtctggaatgagactggggcctaataaaaaggaacatctatacaggagcttaaatgggctgtaccctgtagcattctgaggacaggcccgaattctgagaaggcaagtggtaaaagtattgtccagtcctttttaagttggtggctgagcttggtgaggtgtgtttttaaaagaccattagtccgttttacctttcctaaagattgaggaccgtaagggatatgaaggtttcactgaataccaagagcctgagaaactgctcgggtgatttgactaataaaggccggtccgctatcgcactgtatagaggtgggaaggctaaactgatgaatgatgtctgacaaaagggaagaaatgaccgtggtggccttctctgaccctgtgggaaaagcctttacccatccagtgaaagtgtctacccagaccaagaggtattttagtttcctgtctcgaggcatatgagtaaagtcaatttgccagtcctgggcgggggcaaatcccctagcttgatgtgtaggaaagggaggggcctgagcaatccctgaggggtagtagaatagcagatggaacactgagaagtgtttccttgaggatagatttccacgatggaaaggaaatgagaggttctaagaaacgggctagcagcttgtaacttactgtaggaacacaagatgactgctttgggggtagtgttgggtagctgctattgtgctaagggctgaaattgactgaaattacctacaatttaccaactgggccttcctccagaagttgcaagccatcagtaggctccagagctctgaaatatttacatcagacagatcctgcctgtgcagttgttgtctagattccaggtgcttctcattccaccatcttcccaggatacactctgagcttctggattttgaattcagtcaagctgttctgtaacagctggggtgaaagccagcaatgatcctgctaagaaagctccctggaaaaaaaaagttcaaaagtaacataaatatcaaactggaaagaaattgatttaggaaccaaacccaggttgtcatggtgaaaaaaggggcagaaccttagctactgaactgcagcctggggtacgaggtgacaaccattgcttttttagtttggtttggctagcaaaggtggccttgttatataaataaagcccctctggtagtcaaaacctttattttctctctctctcttttttttttttttttttttttttgagaaggagtcttgctctgctgtccaggctggaatgcagtggtgtgatcagggctcactgcaagctccacctcctgggttcacaccattcttctgcctcagcctcctgagtaaatgggactacaggtgccagccaccatgcccagctaatttttttgtatttttagtacagatgtatttttagtagagtttcactgtgtttgtcaagatggtctcaatttcgtgacatcatgatccgcctgccttggcctcccaaagtgctgggattacaggcgtgagccaccgtgcccaatgaaaacctttattttcgtgatggctgcttatttatttatttatttatttatttatttatttatttatttattaatttttctttccctgctctccctctttttaaatttttattatttatttatttatttttctgcagagatttatccaattcagaggtcttgtccccataatttggaacattcctttggatttgatcaagtcagatagaactggtcaaacccaatggggaaaagaaggaaacaacaataaaaacaaacagaaaacaaaaaacagttcagaaaattaatgatcgcacaatttatatgattgcttagcactctaacggtaagaagaaattatgatcagttggttgttaatcttttttatttttttattttttattttttttgagacagagtctcgctctgtcgcccaggctggagtgcagtggcgcgatctcggctcactgcaagctccacctcccgggttcacgccattctcttgcctcagactggttgttaatcataactttaatcatttaggagaatttcaagacaaaacacaggttcagttacttacctaggaatagggcccaggctgaagactgctctgtaccatcctagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaaccttagatctcgatcaaattttgggaaatcagggattctctggagggggtggatctctgaggcctcagcaaattttcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaagtatagcagccaggtgcaaattgtgggggcctggaaataattttggtataacacagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccactcgctgtttagccctgatttgcatatgagactttgtgctagtcatctggtaacttttcactcagcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactttgaggtgggtgaagattagagcctggattaatcaagggcctgtggcttctaacaccatcagttgcctgtactcagccaccttcagcagtgctatctggctctagagagccatagcattccaggaaaggaaagaagtctgcacaaagccctgatgtttgtgtccccccatctagacagacatagtagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcatcaatgaagagtttcttcctcattgaatcactaacacgttttggatctctctgacttcctagtttgctgacctctgacctctagatccagactttaaaggcccatgttattagattagtcaacctttataatctccccattttaaggttaattgtatctgcaaaatccctttgccatacaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgtattatctgagttcctttctcaggaaaccaagcgttgggccctccagatagtatcaaagaactgaaatttaccagagtaccacatctggacaatgaaatgtcagaccccttatcccatcaaaattgcctaagtgaccacctgcttcctgttgaccaattcctctttcttacctctccctaattcctgttttcctgtatgtagttccatttcttccctgctatctaaaccctgaattttcattggtcaggaagatggatttgagactgatctcccatctcctaagttgtagtacctgatgaaagccttctttcctagcaaagctagttgactcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagagtacaattataaatacacatgcatctaatagagcctcaaaacacaggaagcaaaaagtgacagaattgaagggagaaatagacaatttaacaatagtagatggagactttaataccacaactttcaatagtggatacagcaactacacagaagatcaataaagaaataaaagatttaaacaacataacctaccagacatctatagaatactccactcaacaaaaacagaatacacttcctctcaagtacacacaggatgttctatagaatagaccatatgctagcctttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccacagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctataattccaatgttttgggaggccaaagtgtgagaataacttgggcccaggagtttgagacccacctgggcaacatagtgagaccccatctacacaaacacacacacaaaaaaacacacacacacacacaatagctgagtgtgatgacatgtgcctacagtcccggctattcaggaggctgaggcaggaggatcacttaagcctcggagtttgaggctgcagtgagctgtgatcatgtcattgcactccaggttgagcagcagagctagaccctttctattaaaaaaaagcaaaaaaaaaaccaaaaaactaacatgcttccccagtgggggaaatatgtcagtataacattggtttgcagcaagaagtatattaagatattgaccaaaatccttttattatttattttgtttttattttttgagacagggtctcactttgtcatccagaatggagtgccgtggcatgatcttggttcactacagcaaaaaacacctggacccaagcttgcagtgagcaatcatgtctcactgcaagctctgcctcctgggttcacaccattatcctgcctcagcctcccaagtagctgagactacaggcacctgccaccacacccggctaatgttttgtatttttagtagagacgaggtttcaccgtgttagccaggatggtctcgatctcctgacctcatgatctgcctgccttagcctcccaaagtgctgggattacaggcatgagccaccgtgcctagccccatgcctggctaattttttaaatttttttgtagaggcagggtttcgtcgtgctgcccaggttggtctcaaactcctgagctcaagtgatccaacaaccctggtctcccaaagtggtgggattacaggtgtgaaccactgcacctggcctctaaatcgatataagtcaattattcacacactgagaggaatattcaggatttttttcttataatataaatgatgtggaaatctggagaaccaaagaagaacaccaagactatctaaaagtgttaaatttttcattaggaagaaaatgaattcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgctgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttagatacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacatactataaaatttacccattataattgtacagttgaataatttttagtaatttacccaagtagtgcaaccattaccataatccatgcatttgtttttaatttattatttgtctgggttctgattctacttccaccacaagcttcagcatggcagtatctgccaccacttgttttggtccaagggcagaaatgagcatcctggaaaccaatcagtacttgcgctctgaactggaaaagtgcaaacagaacttccaagacctcacagagaaattcctgacatccaaagctactgcctactgcctggccaatcacctgcagaaatgtagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggtgagtgtagtgaggaatagagactaaaaccttggtttaggcatgaaactgtctttcccctctcagcaatgaatatcagattccacaaacatgtaacatcactgttggttaaaacatctcaggattcgatttaaacttttttaagagcgcccatttgcaaagcactgtgccaacagcatcaggggtgatagaagtaatagtataccctatctgccttgaaggaacttaaaactagctattctcaactgagtcacagatatgtggagatgtgaacttcaatagcagacatggaaaaaagtctttatgatacctggatcaagattctcttcccacaaaagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacctgttactaatagtcagggaagggaagctgtaatgacaaggaaacatgggaacaagggcatgagaggaacagggatattagaagaggattctggttaacatagaaattgagtttgttttccaatttctacaattattttaaaatacatcattgtgtggggggtggctaaaagttgctgtctaacttactgtcatagaaaagtaaaaccaaaagcccacttattaaagaagtgaaaagatgagctttggtgtgtggaaaaactagtttaaaaaaaaaaccttcactcattataattgtaggaaaaaaatttctcaagctagagaagaagaaagatattacctaagaccctagtataaaggtattattgtgcagtgattaaaaagcatataccctggggccaaatttcctgggttcaaatctaacttatcatcactgtgcctcagttttctcatctgtaatggtaatagagtaggaactacctctttggatggtggtgatgatcatatgatgataattcttaaaaacctactgcaacagtaccatgacaaacactatgtgttggttctccctttaaaacaccacctattagcttttgggcacatatcatttggatctttctcctctatatacagttttacacagctgtatacagataaatgtttaaatctttgaaatattttgggattattgaaactcctgacacaggaggaccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtatggtggggcacacttgtaatctcagctacttgggaggctgaggcaggagaataacccgggagtcagaggtgcagtgagccgagattgtgccactgccctccagcctgggcaaaaaagtgagattccatctcaaaaaaaaaaaaaaaaagaaaagaaaaacatgtggcgtcagacctcaggggatgtgaattctgactgcctcattccagctgaatcatcttgtcaagtgactttatcaggcttttctttcctcatctctaaaacagggagtagttgagagactgaggaatacagatatggaaatcccagcgtaaagcctcgtactggggatacttttatccttgagatagaccctgcctcctgccctgcaggcagtgaccacagcagcatggccagccttccatgatgcaggcatgtctatcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagtagggcagctcaggctggtagaacaaagagcaaatttgtgcaaggagaagggcagaaatgtatgactcaggcacagaactagactaagacacaatgaggttatggtctagttaggtctctagggttttccattaaatagcatattagtaaaatggagacagctgtctgcattggaatactagcaatgtggcttctatttgtgtgtccttggtcaaatttacttcacttttctgcgtgtcattaaactaggctacctcatttataaaatgcaaatactgacagtatctacttagagggttatgaagattaaatgcacaattgcaagtagttagaaccatctctaacacatataaaactctgaacaactattttctgtaattattatatttgtccccatttatagatgtggtgattgtcattaatattttctataagagatattttcaaactttccaaagtgcctttcatgataacaatgtttctcctccaaactttttaaaaaagtattatactaggtggagtattaactggtagggctgttgggtagatagatgattgagcagctgttgtgtggaaaatgaattattaattcgctcaggaccagcattgactatccttagagggtttcagacataaggtagattgtcgcattcgaaacttcttttaatcctttgttgaaatgaaatcatagaagctcaaatttgtaaaactcaccaaagcagagatatttgattgaaggtgggataggtctggagcccctgtttctccccagtatgtgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgggtacatactaccgggtgctgtaagttgggtaataggtagcactatctttagactcacagagctcacactctacattggaacccatgtgtattagtccactctgacactgctataaacatatatctgagattggtgatttataaagaaaagaggtttaattggctcatggttctgtgggctgtacaggcttctgcttctgggcaggcctcagaaaacttacaatcattgcagaagtcaaaggggaagaaggcatggtcttcacatggccagagcaggagagagagagagagcaaagagggaggtgcacactttcaaacgaccagacctcatgagaactcactcactatcatgagaacagcaagggggaaatccaccaccatgatccagtcactatccagcaggtccctggttggattacaatccgacatgagatttgagtggggacacagagccaaaccatatcaccatgagaaatatttaaacaataattagaaaaaaaataaatccgcacagagtaatgaaattactactcagaactttactttttttctttttttgagatggagtcttaccctgttgcccaggctagagtgcagtggtgtgatctcagctcactgcaacctcaacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcatgagccactgtgcccggccagaactttagttttaactgccttcttactgattatagtctatcttcatgtcattcagaagaatactgcccctcttgaccttttcactgatttttctttttaactttcaattaatactagagataccggcccaacagttttgaacttggcttttttttttttttttctgccagttactgcatatgaaaaggtacatgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacactgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggagtcagaggcggaggttgcagtgaaccgagatcacatcactgcactccagcttgggcaacagagtgagaccctgtctcaaaaaaaaagaaaaaaagaattcaacttgggagttccttacagggattctaagagatctctcctctgaaacttctataacctattattcactacattccctcatacattttactcttctttcccaccttaggatacatgatcccttaattcaggctcaggctgaagaactgacccacttacaacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgccccaaagtggggagaaaaaatgcaaacttatctccattatagattttattttagttttgactatggtccttaatctgcattctattgttttctctttagagcactcaggtaatcacttttcatattctttctagaattctaagttttgttttttattttgagacagagtcttgctctcttacccaagctggagtgcagtgacatgatcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggctggtcttgaactactgagctgaagtaatccacctgctttggcctcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccactgtcttctggcttacactgttccaacaagaagtctgccataattcttatttctgtttctctgtacataatatgtcttttttctctggatgcttttgagattttctatttatcactcgtttgaagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaatttaatttatgtctttttttaagttcttctatgtaactcttcatcatttcatattttcctctagcttctttattttattttattctattttttgagacagagtctcgctctgttgcccaggctgaagtgcagtggtgagattttggctcactgcaacattcacctcctaagttcaagtgattcctgtgcctcagcctcctgagtagctggaattaccggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctctccaagctggctttttaatttttttcaggcagcataagagcagctattagtcaactgctattttttttcccactatggaggcaaaatgacctttaagaaaatagaccttattttttagagtagtttcagattcacagcaaaattgagcaggaagtacagaaagttcccatataccccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcacgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccgatgctaatctaatgccatcgttgatctgacaggaggctgagctcaggcggtaatgctttctcgctggctgctcacctcctgctgtgcggtcccattcctaacaggccatggaccagtgctgggggttggggactcctgttctaaccaatgctccctctattaaaagggattttcacactagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgtcttcttcaaagttactaccaggctctgcctgggtcctccctccctgctctacagttgacaatctcaggcagcaaactggagcaatcatagggctcacctcttttatttattatagtactgcactgtatccaatgttgaagatagagtttaaaatactttttccagtttctcagttgtttaaggtggaggacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaagaattacccccaacaacatctgaggaagcacaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcagccaggcaagtattctttgagctggggaacaaaaggcatttaaaactttttgctctgcttcaggcagctgacgtctggtgatgattcaccatatcaggaacaccctgtccagtgggctaaggcaagcctgccaggccacttctctaaagacacaacctgaggcctcctgcaataattctcacagagcattctgaacatacatgtaagctgttatgtccctgatcatatagggcccatgtgtgcaatgtgtgaaatgggacctgcttaatttctgactagctctttctaattttggtttgcagaaaatcacaatggtaagaaaaatgaagacaggcaaaagccactggctcccaggtaactctacatgatgaaggggctgataatggactgaccaaatctagagagaattccagaagcaaggactcaagaggttgaaggtcccagatctagaaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcattttacaaggtcaggagttcaagaccagcttggccaacataatgaaacctcatctttactaaaaatacacacacacaaaaaaaaaattagccaagcatggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaggttacgtttcatttccatatcattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatggtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttacagtctattggatattatggtgaagggcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttgaatcaacttcattcatcatggaagaatgttccattcataaacagattaaagagtaccttagatccatagaaggtgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgatcatgcgcttactctgagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcatatgcaaaagggctatgagtaggaggaaaactcaggcctctgaggtctcctgaaagagttttgctaatgtcacaactggctttctatgttatctgaagattgagatctccatgaagagtgaagataggtaatgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatacttgcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcatctagaggggtcttactggaagccttttactcagtccctttaatttccttgggtgtatactacggttccactgacatggatgacctggtagtagcgcagcagcctgaaataccagggtttccttagctgtggccttagctgctctttccaaaagggaatttcctctaataagaacagtgtcttccttctggtgtcccctgcagtgaatacttgttatttctttgggaattggacggcatctaaaagttccaagatctgagtaaagttgtatgggggatcccttggctcttgatagtcccctttccttccctatggttgcatgagcctgaagcacccggaaaccatacttagagtcagtaaacacattgactcttgagggtttttttttcttttttgaaacggagtcttcctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgtaataatccatacttcattatcaggggatggatgccccttggagccaaaggtctaaaaggatactggatttttctttttttttttttttttgagtcagagtcttgctctgttatccaggctggagtgcggcggcgcaaggctcactgctacctctgccttccgggttcaagcaattctcctgccacagccttctgagtagttgggattgcagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatattttttttcccatagataattaacactgggtttcaaaataacctggactgggagaacatttgcagttcttccaggaactaccatgtcacaagcagacgggtctacttgagaagtaatatttgatggaaggaacgtcttttctttatctgtgttaagacatgaacttagagctaggagaagtgtcccttcccagcctgtggccttctcttgaggtgctccaaattgaactgcagcctgttattgggaaagtaagtctcttcccagtaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggccccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccgagaagctcagactccgtttggagactgaggcagtctttcctccagtggccctcttgcttacagaaggcacactgattccagcctaggggatgatgagctggcttttgtctgggcatcccaaagccactcttgcaacactttctcaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagagcccgcccttccgggttgtctgggtctacattagtatatttcctgagtgcctcaaccaagcagccctaaaacagaatgggattttcatccttccactgagttacttctctatccttgtcacaattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatacttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtgggggatacaggctggagctagctaaataaaagggagggttttctgatgacattggggtgaaatcccacactggagaactggcaggacccctcgcagaactgggggactgagaagaccctggagagggcatgggccctccagggggtgccgctaggaagggagcatcgaggatatcccacgcggtttcttggtgcctggaagtaacatgagccagacacatcctgcagttgactcttaagtcagaatcctggtagggggccatagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagaagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaaatatttgggcaaaatgtttgggtggctgctgcttgtctgccactatgggtagttgtcacttgggccaggggtccaggaacccctggtccctgtgaccaagagttcaatatgggcttgagcaaagtcacgtaggagggggcccacaactggctgttatggaaaattgtaatcttttaatttaagggcggagaagatgacatccacactcctccagggaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcactaccaagtgtcctgccttaaacagttcttgactctgtcctgtcctgtcctgtgttatatcatgtcctgtcccatcttgttttgtctttgtggtcaccagatgatgcaaggaaggacaaccccaaaattggggcttagcccaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggttattcagaactttttggaaaagggatgaggagtttccagaagcatataaggtaacttcctggccattgccatggcaagttgacatggcatttataaactgtcatggcactggtaggagtgtctttatgctaatgagcagtgagggcaactagaggtagcttttgtctccatctgctggttttggtcagcttctttactgcaccctgtttggaccagatcctgctctgatcaactgggccacaaccgcaaaataagtcctgccactttcctgcctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacatatcattagctggaagctgcctctatccatatattaaaggtttctccatatgtagtgaactgtaacctaactggatgtgtaaacaacctgtaacctactcttgagccaatgactgaggtttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtattatatattatatacacatgtaatatatatatgtatgtgtatatataatatttatttgagagagagagaagtgacttgtggtactgatgttgcttgcctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcatgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccaggaccatcaaaagcacacctgcactaggtcattgggaactttggaggtgccttacatctgggcatgcattgaaccaccacacaaggtgaaatgcctcttctcaaagaggcttgcctgcagtttccactaacgaaattgtgagtcatagctgttcttctgtttgagatattaggagggattttgtggggggtgaggggggatgaaagtgagtttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaagtggaaagattgactgagcccagcaatttgagaccagcctgggcaacatggcaagatccccatccctataaaaatttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagcgtttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcacgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaacaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggacaccccactggccaacgggaccctaggcaaaccttataaactgagtcccaggccaagaaggaacgggaggccagacaagcctcattatattcccacccttttgcaatttagacaaaactgaccaacattaatgttatcacagagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaagtttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcattatctgtgggagagttactctgaaagcagcaagaagccattaccagatgcagatctcattctgtcagtaatggcaacccagcaaataggacaggagccccacccaggttggatcaatgcatggctgtataaccttgagcaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcaccattaactccccttcttcaccagagttttctggcacccaagactacagaaactctcctgcagtgggctttggggcacatcgcaagttccagtaacaagggctaagatcgcccgcttttggagaccttacaaagcatgtattccctgaccaggaatcgaactcgagctgcaggcggtgaaagcgccgaatcctagccactagaccaccagggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttaaactctctattgaaaaatgaacaaatgttcagaacagaggaagtagagtggtggcaccatcaaaggcaggaagggccaagagaacctgatgggagtggggatatagacctggttctagcttccagtcttccagtcactaactttctgctgtgtgcagggcacaatggaagtaaacaccacccactatatatcccctgtgcctggcatacagaatcattcatacatgttgaccgaagggtttcctttgcttctaggggattatgtatcattttgggaggaagcatgtattctgtgaggttgtttagtttatgtccaagtgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtactctttatcatatgaggagagtgctaattaatgtgtcatttattttgtgagcatgctaataaatatattcatattccaatttagtgaaaaaaaattgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttctatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagctgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctctctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccatgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatatgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgattttttgctgtgagacaaacttgaaaagttcacagacactgcctttctctgaaaactgcccttacctctttgttacaattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcctgtgtccttcagtggtgatggctctgaaacccttgtgttttatgaacttcatgccctggtcttcaaacgaattcagtgcaggccaagaagcacagtttggcctgggttggatgctctatattttcaaacagtgaaatgccttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcaggtcaggcccttcagcctggtggaagagcaggcagggagggtcctatggttcctgggaggacccgaagcatgatcacctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgtggaaccgtaaatgagggttcagcctgtctgcctgagggattgtgtttcctggcgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacacgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaatcccaagaggtagatgttgcggtgagctgagattgtgccattgcactccagcctaggcaacaagagtgagactacgtcttaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagaagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaatatatatatatatatatatatatatatatatatatatatatataaaaattagctggacgtggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaccgcactgaggggaaaagtcaatgtgaaattctacaaaagctgaaaattcactaccaccagccattaccacaaaaaaaaaaaaaaaaaagttgaaggagtcctccaggcagaacgaaactgacatcggatgaaaatctggttgtccaaaaaaaaaaaaaaaaaaaaaaaaaaaactagacatgacatctaatagaagaatatataattttaacatctgactgtttagctgggcgtggtggctcacgcctgtaatcccagcactttgggaagctgaggcaggcagatcacttgaggtcaggtgtttgagaccagcttggccaatatggtgaacccctctctctactaaaaatacaaaaattagtaaggtgtggtggcccacgcctgtaatctctgctactcaggagtctgagtcaggagaatcgcttgaacccgggaagcagaggttgcagtgagccaagattgttccactgcactccagcctatatggaacctagtttgatctggagggatcttattttataggaggcttggagggggaccttttgctttgtgtactcataggatgcacaagacacaagggaacaatctctcactttttaaatacagtgataggcctgaggagaaacaactgcaaattttttttttttttaatgagatgggattctcactggtcttgaactgagctcaggcgaggcttcccctacgtcggcctctcaaagtgttgggattaataggcgcgagccaccgcgcctgaccacaactaaccaacatttaaaagcacgtccctgggtaggctcgaaccaccaactttccggttaacggccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttccacgttagaaacgcttgcattgcctgactctgaaaccagaagggcggccgaatggccttcaccctccgttaaccctcgcctgcttcagaagccagtgcctctggaaatgcctggatctgcgaccccagcctgagcctagtagggcccaagggaagctgaacgccccgacggctctcatggtagctctttctgtttttttgcgccgccttcaggcaatcatctactccgcttgctatcccctcactcaactcggcttcagtagatggggttggtggggcgggagcgggaaagaagcaggggagtcaaaagggaaaacctgaaaagaaggagggagaagcaggggagaccaggacaagacaatgggacagcccaggatgccggtgcagagggcaccggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggggaccgggagcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgtgtcttttggtttgcctttaattcctgcaccagctgcggcctttatctgcagccagaaagcaggttttaccgctggtcccacagcgccatacggtctggggaaaagaaggaaacccaatagtacacaaacaaaggccaaaagagaaaccttccaagtgctctatgccttacggtttagcagaaaatatcaaacaactctcaacctagctggtctgtagcttccacaaatgaaatactgtattcattgcagcctttctggttgagatatttcaaatatttggtggagcttttaatgagacggagagacactctcgagtgtggaagaaaaaaatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctacagggacagcacagcgtcctcgccctggccggacgctcagggtcaccaccctacccactgcccccctcgccattcttccaaaccactctctgccaaagattccaccgacagtcaccccacacgacaacccaggccgcctttcagcagcggctcccgccccgcaaccacgcgccctctcacccccgcggttctgcccgccgcctctatccagtctgtgcacttcacctccctggctcccgctctcccctgagcttacagtggacgcggggttcttccgaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacagctcagcccgataggcacctccggggcggcgacggcaaagagggtgcccttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctagctgcggaggctgttctacatctgacccttggagcaggccggctgacagcgtagtaaaggaagatttctgcgggagggcggccagtgcaaaacaattccctgaccgggaatcgaacccgggccgtgacgctttcagcaccgaatcctagccactagacaaccatgcagatgcggaaagctgctttctctcccttcttcgacctgaagcgacactttcctgtgctctaggaggacttgggtcttgtgagagtcgctctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgcgaggcggcagcaactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcaccaattcgtgatttccgtcggccaagtgcgtgggcattgatctacacgtgagtttctccacctctgccgaatggctacttcggggtgggggaagggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttttcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcagatgcgcggtgcgcggggaagaagaggatttgactgcggttctccacccccggcgcctaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatgtaaactgggtggctaattcacaacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaatgggactaaatccagactcagttattgcaatgtgtgcaaaagaacaaggacttgtactatctgacttcaaggcttactataagctattatagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctccgttcttctgtggttagaagacctgaacccaactccctccccaagcactggagatggggcttttccaagggctagggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagttttttttttcttcttcctttttttctctagctaaacaagcactggccttgagataagcaatgctgaagcacttgcagctcacctattaccaaaaactgactgagccctccctacacaagccataactactgctttgattggacaagagactgatttcagtagttttctcttggtaagagaccactggccgtgggctggttctggacagtttacagaagctatgcacttgattgcctttgtgtccctgcttcaccttttgaagcatagggcctaattataatgtatttaaatgttgtctccaccccaaagtgaacatgggttgcatgtaacaggcgtgtttactcagcatgcatgcagcaggatcccttcacaaatattcagagctccccctattccctgttgaatatgtatatgtggccaaccagatcaacgtaaatcactattcgccctcccctccctggaaacttacttttcgggtttcagcaggaagctatgcctcccagtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcaaataggcctttgcaaaggagaatttcttatatgctggaagccataaaaaaatatgcttcatagtattgctcattaggcaagtacaaattaattccacactgagataccactaaccaatcaccagtgtgtggctacttttttttttttttctgagacagggtctctctcacccaagctggagtgcaatggtgcgattggtgcgatcttgagtcactgcaacctccccctcctgagtagctgggactacaggtgcatgccaccatgcctggctaatttttgtattttcagtagagacggggtttcgccatgttggccagtttggtctgagagcatagctacattttaaaaagttagcacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccagtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtggactaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctacaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcctggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccctccgggagcttcatttcttgttcctctccgtagtggctcagcggtaagcccaaggtccagcacacgaatcaggaaactgatggttcttgggttagcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatatcttttgctgctactttggtcagcgttgttgtcagtttaccttgtggtggccaagcccttaaatgcactattaggttatgcagtgtaattctgcagggcagaagggtaaagagccatagtgaagagcaaaaatacctcttatcttgaccgggaattaaacccgggtctcccgcgtgggaggcgagaattctaccactgaaccaccagtgcctctctctagcaaccctgggagaattatcaaaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcagtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagtagagagatttcttttctcaattttccctggagagattaaactgaagagaaaaattcagagagtttgccccacatgttgggtctgcgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctatatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaatagcgtttaagtttattggatactccacaagcttactgccactttattaccacacttttccatctatcggctcttgcatccattaacataagcagacaaaaaactggactcctggccgggtgcggtggctcaagcctgtaaccccagcactttgggaggccaaggcaggcggatcacgaagtcagaagattgagaccatcctgactaacatggtgaaaccccatctctactaaaactacaaaaaaaaaaaaaaaaattagccaggcgtggtggcacccatctgtagtcccagctactcgggaggctgaagcaggagaatcgcttgaacccaggaggcagaggttgcaatgagccaagaccacacaactgcactccagcctgggtgaaaaagcaagactccacctcaaaaaaaaacaaaacaaaaacaaacaaaaaaaaaactggactccctacagccagtgtagtatgcaccactcacttgccacactgtatgctgagtgacccttccacagcttaaatctgcacataacttcagcctagagccatataatgtccctttatttcttcagtacaatgattaataccatattctctgtacccttcttccctctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagctgattcacctccttggtgagggctctctccctggcttgcagactgctacattctccttctgtcttcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccatcctctgcagtcatcctgtcagtttccattccattctcctatccctggcttgctggttcaatactcttaagtgatttactgctggtgctcttctttttccctcagagataccttgtgatttctttgattctctccacctctacaggttaataagtctaatatttaaaaactctgtagaaggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaaacgcactgccgagaggccagaaggcaaagcgagagtcggtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagagctaacaaaaaaaaaaaaaaaacttatgtttccgcccggtttcgaaccggggacctttacgcgtgtgaggcgaacgtgataaccactacactacggaaaccacaggcggaacctgcacggcaaaatataaccatgaaaatcttagatcagccgtttctattatagtttccaaatccgagatcgcaccactgcactccagcctagacgacagagcgagagtctcaaaaaaaagttgggagaagaaggtgccattttccctagttgcttttcttactgcggtggtgaccgcattgccttcacacctgaagtccaagtgcttccaccctgcagaatatgcagaccgctgggtcactggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccaaaggaaaagcgcaaaggcggcccaaccccacgacctgagcaagccaagggtcgcgggttaaattgcgtttatcagaacagttgtttgctcactgtcccaaagccctcctagggacaaagaaaacactggcatggcaccaatcgcagaagggggcagcattgacacccaggaacaggagtggaaaagcaggaaaagcagggatcatctctctcctaccccgtatatggctgcagacatagcagtggttcttttctccaggacccagtgagtgtgcaccaggagagaaaattatgcacgttattcatggtggcaccacccaggctgaaagtgagcctgtgctgcttgggctttcaggaaggacggacccaactctccctccctatacagagctgcagtgccctggcaatggaggacagaccatggagttgcctgccctggactcggggaagaggctctgccctaaaccccattttagtggtagctgtcagagtggcatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactgaactgcatcctaaactggaccactgaattcaaaaaccctgctaccaaagggcttagtgctagtccatgagataagtttcctgagaattccgtaccctcagcccccaacaagggttagtgtgttagcttttacttccaacacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaaaattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgttggaaatgacagataagaattccaaatacggattgcaagggaactcaatgagatccaagaaaaagttgaagtccaatgcaaagaaatcagaaaaacaatacagaatatgaaagacaagaaaactatattaagcaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccattgaaaagcatacagtcatcagacttcccaagataaatgtgaaagaaaaaatcttaaaggcagctgaagaaaagggccagattatctataaaggaaatcccatcagactaacagcaaacttttcaacggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatataaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaggcatagggtggcaaattgggaaaaaaaaaaaaatcaaactttccatggcctttaagagagacctatcttacatgttatagcccccagaggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttaaattggactcttgactaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaaattgaaacaaatgaaagtagagacacaatgtgccaaaaactctggaatatagaaaaacagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcgagcagaactaaatgaaacagagataaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttgaattcctggaagcacacagcttcttaagattgaaccaggaagaaattgaaatcctgaacagaccaataatgagttatgtaattgaatcagtaataaaaattctactaatctgaaagagccctggaccagacagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaattctcaacaaaatactagcaaactgaatccagcagcacatcaaaaagataattcatcatgatcatgtgggctttattcctaggatgcaaggatggttcaacagacgcaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcaggttacaacatgagcatacaaaaatcagtagcatttctatacactaaaaatgctcaagctgacagccaagtcaagaacttaatcccatttaaaatagccacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcacacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagctgagatcatgccactacactctagcctgggtgacagagtgagaccctgtctcaaaaaaaaaaaagaaaaaatccccatggaaccaaaaaacagcccgaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaactaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcttatgactaagacctcaaaagcaaatgcaacaaaaatgaaaattgacaaatgggacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaattctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcgccacagccagaagagtgactctgagtatatgaatgaggggctacagtggactgtccagtacctagggagggagagacagggctgcaatgaagtctggagggatttaggaaattcattgattgtaccaaacaaaaacttacatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacacgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttccttctggaagcctgaaaactccagtttgcttccctgagcccttttcctgttgcacaactagggtgtggactacaggtcctacccatggaagatggaggtagatacttcacagggaataaaaacaacctagacaagtcatacctttaggtaacagatactttcaaagatgtactttcctgcacccattaaagttttagtctcagctaatctgaaaacctgcggtcctcatgcactgggatagcagtgcaatatggctcaggctcaggttttgctgggcacaccagagtaggccacacactctcatgtgcagtggcttcaggtatggatcagggtctttcccactaattggcttcagttatgatgttgtaggtcatcattcttctggctttaatatgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctccagcctctccctcaggcggtcattgagactgatggactcctccaggcgctggcgcaggttctgcatctcagcaagattcttttccagcaggtcggcccctactgcaaaccaccaagacataggagaggtaggaggtagggaagcctgatcatccctgggcagctgtggggcctgcctggcaactctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagagggggaacaggagagaagggaacaatctccaaggaaggaaaaagatgcacagagagaggaggctgagaataggcctcacccactgggagattttgcgtagggtcaggtttttctctgagaatttaaaatgtcttattgttacactacctgggacacagaaatggagctgcttcaagccattcctctaaatacctgcactcctagctgccaggtgccaggatgtttggctccaaatccaaaagcaatgtttatgggggcaggattggcacgtggttgtatgcacagtgtgtgtgaaagatgtgtgtgaaagagtggaaagagtgtgtaggggtgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtaagttcctaggtagggtggctaggagaaggcactttcaaagaacaagcactgagctggttctcactgtctggctgatctacatattgtcctgtcattttttatgaaccaggttctaacagaggaaccaaaaagtcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaatgagtgttttaaaggtaattatagtgagttgaatagtgtcctccaaaaattcattcagttcacttggaacttcagaatgtgatcttatttgtaaatgggttttttgtagatataataagttaagatgagatgatagtgaattgggggtatgtcttaaatccaacatgactgatgtccttatgagaggagaggagacacagagataaagagacatacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttaggcgtcttcatctccagaactgtgagagaatacatttctgttttaagatgcccagtttgtgtttttttgttttggaagccctcgaaagctaataaagcaatccacggaatgaagactaaggcagatgtcagcagactcatttcccaaggactccccatttcaccctaaagtaactggcatttctcagcctatgacataagcagtagtgttagttgtaatatctgagcatcacagcgcacatacaggaaaaatatggggcccctctcctagcttcctttatgattcccaatgctggaatgaacctggggaggtacttcagaaatgtttctcctaatagcaggactcacagccaatcctaggagttcagacagtgaggggtgaagcattttgttggtctgtaaacaggtgactatttattcaacattctatgcccttgccagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccacagaatagctagtgtactcttgcatagaggattgtagaatcacaaaatacatggcatcttacagctcaatgatgccatgagaacatggccagatcctctgggcccttcattactgtctccctttgagagaaaaacccagctggggtggcagggccataattcagagaaaagttttagagtctttccctttcaaggattattatcaagggctaaagaatagacaagtttctcctctgagcaggtgggagtgaggtttctgtttgccctcaacaacatcacgttcttttaggaactgtatatttaaatcagtaaccagtaggtctctccttctccaatttataaaatatcagatactaattagaatcactgtgagataaagagtaatgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacattctctggccataccacacggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaaccgttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttcagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaatccattatgggccgggcatggtggctcatgcctgtaagcccagcactttgggaagctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactctgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcctcttcccgtctctatcaaggctatcccaaggaccctctcagggaaattctcaggagggacacgctggttggtgatagactcagcttgaacctcacagcatggccccattcactgatggtttagagggtgttacagcaaacttattaggatgatggatgggatctgtaaatgcataaatgataaagatgatttagtgatgaacaaaaaataggaactgttgctgtttaccccagggattccaggattaggtgcacaatgttagcaacactcatgtccctagtttgaaagatgacataattgtgtgcagtgaagaggaactatttgccccctttctccccttcccaacccatgccccccaagaccaagaccatgtatgtgccagaggagatctagtgactgatggcatgtgagactgggaacggagaaaagctacctgaaaaccttggggcttatgctcagcactgagtcctggagctgtgcccgaccaggtacatcacggtggatctacagggcccggctgcaaagatgccacctcttggcctagacaatgcatgagcccccaaaaactggagccatgtggctactcactgactacagtcactgaaggatgcacttcctccttgtcaagctgtggagacgtgctgctcagggagtgatgtggggtagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctgagggctcacaggagatgtaaaggggaggtcaagaggatcattccttcagaggagaagccaaacaaatcatttctgtttcaggatagagtatggagggaaggcggggacagagagagcaacagttgtccggtgcattggctacaaacatcctgaggaaaaacgaagccgtaatgggccccttaaataacactcatgattccttcacaaaacacccagagacccataagagttcaactccaggtatgggcatggcggtacatgcctgtaatcccagcaatttgggagaccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcatgccactgcattccagcctgggcaacagagcaagacctcatctcaaaaataaaattttaaaaatgtaaaaaaaaaaaaagaattcaactcattctgtgaacataatttttaaaatagtatttgccataggccatttaaaacagattccccaggcaatgtagcctcactggtgtcttgcagtttctagatctccttccctaagtatagagacacagtataaacttttgtttgcaagaaaaatttgtagccgttttacatcttccagcgctccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatcactaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggaccagagacttgactacctgatgcttgccttgattccaggatactctgaattttctcagatcttgggttgagtctttagagagcttgtctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgttccttctgtctttctgccaattagtttcagaggaataccatcatccctggggatgcctcctgccctaacagtcatattccatgagggatggaggtgctggtgatcatcatggcatcctcaacccttcttcttggagctcctctccagccagtcctgactctgtcatggtcttaaggtggtgattacaaagcaggacaccaggttgaaaagtgacatgtgaatgggggtggcatcctgtgaacttaggaccttgggagagactgaaaatcttcctaagctctgcggccaacttacctgtgctgaattttctggcaaggctctctgccagctggcttcctttggccagctgctcgcagtagtgctgctccatatagtggtcaaagttattgctctggagtagctcctcaaaggtctttagtgtgttcttgacatgctggatgagaagagcagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaatctctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttatctatgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaggccgggcgcggtggctcatgcccgtaactccagcacttagggaggtcgaggtgggcggatcatgaggtcaggagatcgagaccatcctggctaacacggcgaaaccccgtctctactgaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagaggtcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaatagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatgtttgacaaagggacaagggcaatacaatggagaaaagatagtattttcaaaaaatggtgctggaacagcgggacatccacatgcaaagaaagtgaatctagacacagacttcacattcttcatgaaaacttactcaaaatggatcataggcctaaatgtaaaacataaaatgataaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttacttgttggagggcatgatcatggctcactgaagcattccttgggcatgatcatggtgtgattatggctcactgcagccaaactcttgggctcaagtgatcctcttgcctcagccttccaaagtgctgggattacaggtgtgagccaccgagcccagctatatgattatttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagatatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagtttacacaaaaacctgcacatgatgtttatagcagctctattcataactgcaaaaacttggaagcaaccaagatgtccttcagtaggtgaatggataaattttgatacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagagagtaaaaagatcagtggttgccaggtgttaggaggaaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtgggttcatcagttgtaccaaatgttatcactcgggggcaagatgttgatagtgagggaggctgtgtccttgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattctaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgttttgtctgagatggaatcttgctctgtcatccaggctgaagtgcagtggcgctatctcggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgtgcctggcctagcgttattttagccctaactaacattattctctgggtcagtgaaatttaagtggaatatattgggcagtgacctaatggagcatgaagcaggatttgaatcacttccaaagctgtacaccaaccacttaggcaaagtagtgatttcagtaacttagtatttcagtaactggtgctcacaggcaaatgcgtaatggattaaccccatattatttaaatgcttccaaaaagctataggaaaatggccattaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacgtatgaagaaacaggagattcctacatgctcctggggatccagaagagagaccactcacatgactggaagatttccagctcaggtaaccacaaaggccatatatttggtgaatacaggcaatgttagttagaataaaaccaaatttctctgaataatataaagtcattactaataaaacttttatagatttttctctgaagaaatttccaggaaggtgttaagagaaagccctacaattaaggtatggaggctggctgcaggccctgaaagctgctctgatgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcagggtgggtgctgttatgagaaggaaggggaggtcccacaggtgtttagaagaaaaagcaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttgagatgccagagctcaaatcccatgtcactgggacatcaacaatagtgctatggggaagactcagggtgccagctcttgagtcacaatcacagaattagaatgtggaagtagctacagaacccaaggaagccctgccttctgatagctacactcaatgcaaggctgcgtatttcaccctggaggtctctaacaggggaggccaccccctcaatagccagcttttttacccttttgcttacgttgtcaaccaatttctaaccacagcaaaataacctaagtatacctctccttgaaaacatcaaaacattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtattactttttaatacataataaataatatatcccaatgcgatacttgcttcctttcccttgcagtagcaacgtgtaggggtttcatttaatatgaggtcgatttgagccttccaaactcccattccacccacctttgcttgcactcatgggaaggctcagtctatatctggtttgcccacattcctaggctacagacctctaggactcccagtttgagaggcgccatttttttggagggtagtgaattttgatttctgtctcctttgcatccttcccagtgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacacgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaagagaagaggccattggtagtatatacttgcatttttcttgtaatacttgcataagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattgtagggaatgttaaaatttctcactggtacagttagaaatgaaaacaaagacaataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatctattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggatatatactcaaaagaactgaaagcaaggattcaaagagatatttgtgcacctgcatcaatagcagtattacaataactaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggacattatgcaaagtgaaataaaccagtcacaaaaggaaaaatactatataattctgcttatatgaagtacctagagtagtcaaagtcatagagacaggaaataatggtggttgtgccaggggctagggagggaagaatgggaaattaatgggtatagggtttaggaactttagtctaagaaaggagaatattggatgccagaaattcagttttctttctgttccaagatccctttagctagagcgacatattgaagtcagagttcctaagggaaaatcattgtgtatggagatcatccttgtggatcaaatgtgaatcaatagtagatcaaaagatattccacttttgcagatattgacatttgttggacccgtaagattttatctagtattagatagataagatgtgaaccacttctcaacgctgcagactcaaatactaggaaatactaagaacctcaggacaaacaaatagccagtccaaaaagactcacagactagataagctgtcatctaccacctaacagataatgtatccctgttaaccactatctccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataaggtgcaggattctattagctaagattatgtctcaggtgggcaaatctctgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagtctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatacaaaatatcttggaagtttagctgaagagatgaggagatactctactgctcaatgtgcgccatgtcatctgttgtacctccccttagttaagtcaggagggcaacactccctttattttttattttattttgtatgtatgtgtgtgtgagatggagtctcactctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcggcccctctatttatcagacagatgtatagaaagtttattgtgctagcaagagtatgaagaaaaggattctctgagttgaaaaaacaaattggaatataaattggtaccacttctatggaaggcaaatttacagggcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgatcgagcaattagtaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactacatttctttccaacagagaccttcttggaggatgagaagcagccactagttgacaggaggggaagtgaggcatgtagtcttcaagggagcagaccaccgtgggagttataaaagaccagcgacgcctctgggtgggttcgaaccaccaaccttttagttaacagccaaacgcgctagccgattgcgccacagagacatggctgagctcctaatttcgttctataagagggtaagctgtcactaaacgctagctagcaccatccgccttttgcaaaatgactgggtaatctccaaagcctcggaaagccggagcagtcagagcgacgaatctacttgtttgtcaagtttgaaacctgtgcattgagtgattccgaaacgccccgcaccccgccttgcctgcctcagaagccggcgcttccggagatgccgggatcgcgactcctgttagagcgacttgggccccagggaagctgaaacgcccagggcgctcaattaggacttgttgaattaataatacatttgagagacagaatatacaatcgaacaatggccggactatacgtaaaaatataactctgatccacaacctggggccacctgcccaagaaatcaacttccttatgtacgaataaacaaccggggaagccagcctgctattatataagtcagactcacagggagccaggcagttatctgtagtaacaaacaataacatccataacaatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgacgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctagtcaattgatttccaagtgtgcaatgtcccatggggtaggccacaaagaggcctagagtgcaccatctgtgcggctgcagctcctggctctcaacagaactgagatctaagtcctcatgatctgatcagcttccaagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcctacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatatttttgcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacgtaatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcactgttctagaggctgggaaatccaagttcaaggtgccagcagactctgtgtctgatgagggctcactctctggttcataggctgtgccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagtggggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagtcttaacaaggcttaccttctttcttgtggtaattttttgataagcagtttttaattttgatgaaatccaattttcttattttttgtgacctctaagacatctttcctaccctatgattgtgaatatattttcctacattttcttccagaaacgtgtttttatttttatttttaaatctataattcttcttaatttcatctcctgatctcagcacaatgcttaaccactataaaatccacaacttgcagaccaacagttcaatctcccagaaacttgtataacccttgatgtaacaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcgatctttcttctgtaaaatggggctaataagagtagtcttaggccaggcgtggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggcggaggttgcagtgagctgagatcacaccactgcactccagcctgggcaacagagcaagactccatctcaaaaaaaaaaagaaagaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtttccatttctaatactgaattgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattgctttagtaccttttttgaaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacagctcaataaacctgaaatgtgtacatcctatggtgccaccatgaaaatcaagacatgctgtcacttaatcgctctcatttcactagaggacacatgagctcatgaataacggttgaccccttagccaaagatcctctattgtaccctctggagaaaataaatctctagttaccttaaaagctgatctagaggtaaaatgtctgcaacattcagcaatgaatttagattatctttgaaaaaaagttcattttcaagttgttttttttgtttcgtttttttttttttttttttgccaaagaatttctttttttttctgttacttagtagcatgaagtacaatgtttggtttgcaatttctgttctttgtaggaagaaaaactttagtggaaacaaccagtacttaaagaccattttatgaggctgtcatttacgtattatctcttttgctgtttttgttaaaatgatataaggtgggctttatatgctttctgtatatcctttggaatgtgtatttaaattaaaaacttaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttcctcccacccttgaaagtcctcgacttaaaacccatctagaacatttcctttgctaagactttaaagtattctttcttcaagttaagggcagtttttaaatagttatcagttgcattcttggaattcacagaaagcttggggagaaacaatccaacggcacaagttcaagtgcccaacggggtggagaagggactgcatactcactggttgccaggccgaggttgtccgccttgcctgctttggctgagactggagacggaaactccattcaacagcgactggaggactgaaacagggcgcaagagggcggctgcccttcacctaccggtccctccctgccttggcgccttcggagttcggactgacccgggatgttgctggagcccgcaggaactgcaaactcaccgcgcgcgtccctgcacacccgcacctgcgcctcgagaactcctggccagttgaatacccggtcccccgccgagcttcgctgcaggtcacaggaaagaggtgcagggttgcgtacccggcgggagaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggatggagggagggaagaaagatgaaaaaatcaaccaaaaaaagaacatgatttcctaactaatcggatgtgggtcatgagagaaagacctgcgtcgagtttttggcctgaacgtgtggagggtggagttgccattaactaacgtgggaaaaggcaggtgtagtacgttttagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggcgcatctttaggtcggtagtgaggtgcggccgggacgctgcaactcgctccgggacttgtaaacctggcaggtgttcgaagagggccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtaatttctgctgaaacaattgaaggaggaaaaaaaaaaaagtatgtgctttgtggttccctggtagtctagtggctaaagtttggcgctttcaccgccgggactggttgattccagatcaggggactgggtctcggcctcactgtgaggtattgttctttcctgtgtttgccatctgccaccgctgtggctcaattattccaagactgctggagaaatggaattaatgtcgatcctaaaatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatagtctcatgggtatgcttgagactttaggcccttgggacacctggtgcacagaagggtcccaaaacccatctttggaagtgttggcagagtaaataggcaccagtaataaaggcaacggcgcctgaagacctaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttattggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatgtatacgtgtgtgtgtatatatatatataaccatatgtaatttcaaaaggtaaattaaatataatgggacagtgttggtaacctcttagatagtgtagggctaagatagctgaatttatggcatggtgttgtatacttcagatatctatgctgtaatattaaaatggcatttccttggcccactaaattgtccatttcctggcccaaaaagatacgcgaaaggagtgaaaatgggaagaaaatagccttttgaaggacttgcctaataaacttctcccttagcattacttggagtgacatcagaaaattggaatgaagtaattgtgtaatgtaaaaaagacaaattctctgctgtctttctcccccaatccttaataaacaaaggaggaaacctagactcaggttaggttttctcttcttattctttacataccaggacaagtactgagcttgtttgttactatatggggacttagtatattgtacaaaggggtgtggctattactatcccttttctaccagagcatcaaaactggtaacttggctggtgttaacgggagcttctaaccttgaattcccactccatgtgacttctttctggttctctcttctcagagaacttgcagccatcagattcatttggagaagtttgataaaggttactttacgcttagacagaagaaaaaaccctaaggtcttgaactgagccttatcctctgatacagtttactggaattccctccactgtggcacaagccctgctgtaaattgtgattatctataccttgtcagttttatctatgtatatatcttttacagtaatccccacatccaccagagaacctaggttattggcagaatgaggtttgggaattctggtcctctggccagacactatcagttagtactctgattccaccatttttgaaattatatacaacaaattttaagtattgtttattttggagagttcaggttaaaggaaatgaagactattattcagtattatttctgtaattttgtaattttaaccataacataggtttcttatcaaaacgtatggaagccagaaagcagtgaagcaacaatattttctccaaaacgaacaggccaaactttggcaggagtgacaaatctggcatgcaatggtggcttctatatcagaaatcaagtcttttactttgtgagagcacgagtttttagttttttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgccccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagatgcagtagagagacttctttcgttaaagtacctgagtcaggttgaggggaagagaagaattaggagcacaaagagagcaggcacaccacaggaagcacaactctgcaattgcttttggttttaagaggctgtccattcagtttttttgggttttttttttccttttcttgaaacggagttgcccaggctggagtgcagtggcatgatctcagctcactacaacctccacctcctgggttcaagcaattctcctgcctcagcctcccgagtagctgagattacaggctcctgccaccatgcctggctaatttttctatttttagtagagatgaggtttaaccatgttggccaagctggtctcgaacccctgacctcaggttatccacctgcctcggcctcccaaagtgctaggattacaggcatgagccaccatgcccagcctgtccattcagtttcaatgaactttaaacaacaaaaaatgccatttgggtggctggtttcagtcttccctgtcaatgctcagcctccaaatattcactaacacatagaacaataggaggactgttactctcctctcacacctactacttgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacacccataattccacagcatgacaccaaactggagttactagatgacaacccaagtggtgggttgctctgtcaagaaggggccaattttatattgcagctaggcagttacagtctgtagctgtaccattgaggggatcggggcaagatgcaaatttccatggcttaccagaaacaggtgagaaactgcctgctggtagcctgctgcaagacaaggaggcccccaaaagagatgagtaagaaatagtcttatgataatggctcacaagactacttcccttaccatggtccaggagggcatttggtcaaggtttgagtcatagtatggttgagccttgcctatgtaaagtttaagcaaagccattcccttgtaccttgtaccttgaagagagtttcattggatataatatccttaatttgcactttcttctttttaatgagtaaattgcattttattttattttattttattttattttattttattttattttattttttgagatggagtctcactctgtcgcccaggctggagtgcagtggcactatctcggctcactgcaagctccacctcccaggttcacgccattctcctgcctcagcctctggagtagctgggactacaggcacccgccaccatgcctggctaattttttgtatttttaatagagacggggtttcaccatgttagccaggatggtctcgatctcctgacctcatgatccacccaaggagtctctctccctccttgtgttctggtctgtgaatggctcacacttgaacttagtgtaggctcctagtgggaggagcaggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactggtggaagcctcagggcaaggccttcacttcccagtgacactgttcccaattccctccagcatgagctgagcctcctcaggctgtggttgtgcagcagacagggtgtgaggaaaccctgctcaaccctggttacccaggatggcactgagttctaaaaagcaaaggttatgtggtgaggggcctggctgaagacctggtgtggtacttttgtgagcagtggcaccaatagaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaaatacccaacgtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagctggccacccaaccctaatcttcttcttatgcaaatgggttttctactttactcgcaccatgttgtctgctccttactgtacacgtggttagaaaggaaaagggaagatggagccaccatgttgaacatgcctaccccccaggtagccttgtcctattggcacagccgccagcagtcacctgtgcaagcttccagcttgcttatctatgtctgcagctccattttacaggctgctttttgttagaaaagaaattatttggtggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgtcggccttgtaggtgtggggtatctctagcaccagaggatcattgaggttggggatgcagggcagtgagcagatggacaagagaacttttgacagtcaatgctggagaccactgagaccataggatgttgaagcagatgctgccattgctattgatattggggtgataaattttggttgtgaaagcaacctttgggggcttgaacaggcaatccataggaaagtggatggtcaggaagaaaacacctccttggcaaggactgtcattaattatcacccagaggccccgtggagcactgggcaggaggattcgtctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgcttttgtaacttgttccacagtgatgcctggagacctgagtatgttttatctttaaaatctaataatgttactaggatattgtcttgaagttgatcatcctggtttaatttttgctgccactttatgggctctttcaatgtgcctcatcacataagtaatgtcattttcatttttgtaaatcaagtctcctagattgttcacctgaaagcctgattctcctttagagaaaaaaatgctaaaaaacaaaacaaaacaacaaaaaaaacaaaacattatatatcgcattacaattttattcaacaaatacagaggtttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggagagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaattaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttcctcgctccatagtgaggcgtgacccagcggtcagcccaaggtctagcatgcgaatcagggacgtgatggttctttgggattctagggatctacctggagaatagatgaaagtaacaaaagttttacataccaatattcaaaactgcatcaaactaccagaaacacttgccactttcaaagatagactatgctaagtagctccaggtgtgtgccaccatgcctggcaaatttttgtatttttagtagagactgggtttcaccatgttggccaggctagtctcaaactcctgacctcaggtgatccacctgccttgacctgccaaagtgctgggattacaggaatggctcttgactctaactgcaaggtccctagatcattagatcatttcctgaatatcttatgcttcaggcattggccatcacttgggttaccattgtcataaatcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccacaaatccggctcttatgtgtggtcctggagaaacaattgaaatacaatactgaaaaagacagaaattgttccaaaagaagctttttgcagtattgactaaaagctaacagtagacatccaaaaccaaggtttttacagaatacttttactagacaaaactataaatattaaaatagcttatttgatcaaactttaattccgaaaaaggctccttccaactgcgtaacagactcctatagaaaaacatcagaaattcatccaggttccttgtttctgatcctaaatcttcaatttaggacctcaacctcaaactgttgctttagtggctctgggaaggaagcactaactggcagcataggtaagtaaagttttaatctagggaagaaataagaagcagaatcagaattagaattagaagaaagagggaatatgctataccagaatatcataggcaaaaaaagaagacaaagaaagaggaaatgaaaggacagaaggtaatgctaatggagttagttatttgtggccgttttttgtaaaagagtaatgatcagtcttgtaatcattataatactattatttgctttctaaaatgtctaaaatatttgaaggaatttatgatataaaaagatgaataatgcttgcagtcagtgtttcattgtttgggagaacccagtttcctcagttaatacactttcgtgtaatagctgtttaaggagtaacatggtttaaagacatattaatggctgaaatattaacatattggtcttttgatgaagttcaaatagagagatttctttccccaattttccctggaaagattaaactgaagagaaaaatctggaaagtttgccccacatgttgggtctgggagtcattatgattttttcaaagacaggagttgtgtatgacatggaatcatgcttcttctctagttgagaagccaagctaggtccaggctgagtcataaacttgaacccaacaaggaaatcacccttcacactggccttgcagagctttggctcaatctgttctctgcccaacacccaagacacatactagttctggccaacaaaccttcacatattgtctgtgtcaaccagagctacatttattccgaaatctctttctaaaatacaaacctgtactttctactctcaaccccaaaatttacaagaggcctcatatgcatctcagagtcacagatgctaaaactcaacacaccagtgagttccctgtcagcatcatatactaccctctacctcaatgatcagccccaagccagcatctcccaaagagtagtgtgttgctgtgggtgtttcaacagatcactaaaacctgcttctacccctgcctagacacttatcctcactgctatgcatcctgctcctcaaatcagatcttgatatcttctttaaacactcccaatctcccaacacgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtatcctgagtgacctttccacagtgtaaatctggacatacctgtagccttaaatcatatctaccaacatagtagccaagcaacagcaatctcttttcctttggtcattagagtcctagagaccaagaggatgttgggaaaagaattaccatggatcagctctcagaggcagtaggttctggactcatgctggctttgatacgtgtgcattggaaaagctcaagtacctggcaatacttggagattaggaagaaaggatgaaaataaaccactgcactaaataacatgacaataatcacttatacaaaaattttaaagataaggaatatttaaagatttattagtttattatagctttatagttggagagtgaagaagaaaataccaaagctttttgtcttaacaaaatggtgcagacagattaacatatattgtcacctatgataaccagtcagcataaaaagtatttagaaaggaatggttatattctctaagagatatattctgatgtcatgttttttgctttagagtctattaatatagccacctttttgttaatgttttcagtcaagctccttttctcgcctttcatttccaacctttctctcactttctggtttagatacaactcctaaatatatcatatagttaatttaaaaatccagtgtagcagtatttcgggggtttgttttactggataatttggtccacttacatttaatgtaattgttgatatatattaattttaaatctaccatctttatttttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatccttaatttttttttttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtaataattgataccgttatcctcttcctgcacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttactctttatttctgctatgtctctgaatttccatatgtaatcatggtccttctgcctgagaaacatcatttagaatttccttttgtgttggtctgcttgtgaaaaactgtttcagctatttttctctgaaagtgtctttatttgctttaattattggagattatttttactaagtatgtaattctggaggcagttattttctttcagcatattgaagatatttacatttgattgtttcttttcagaaggcagccaattgtctcgctgctgcttatttgaatgtaatgttcctttttttcctctgttttttgtctttactatttttgtctttgtttttttttttttattgtctgcagttttactactctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaagtagactttctcactctatttgttatatttttgtgtttgtgtattaaatattattttttctccttgttatatattctgaatttttttcttcttcctcatctcccactttactagttctcttttcagctgtgactgctctcctgttaaactcttccattgagctcttaattttgttttgtttttttttttccgaatttctgtttgcctctctctaaatctattctgtcatttttttgttgtttccaattggtgtgtaaattgttaacaaaacccttttctccttctgcatgataatttgaccttaattaactttccagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctgatagcaagctataattcttatcctacatctctcggattaatctggtgccaagtatggcctctgagattcttgtgagcctgaacgttaacttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagttcatttttatcccaagattatagaaatgtaaggtcctaccttattgtaggattattctcctgataaactccccaacttgggcagactctggtcttctatttctgtcccattagtcacagaaggctgtcaaaccctaatatgcaggtcaggaaatgtccttagccaaaaaatggcttctctgcttgcttacggctctgggttccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgttcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatttgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactatgctgccaaagtgactcaaactcaaaaggacaggatgagacttactcagaacttcgaggaagtgtagagaaattatccaccactttttatcctagaggtgcttttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaagagtcaagtctatgacttacaagcttataaagatccctcagatgagttatgtacatggattgagaatcagaaaaggaaggatgctctctcaggagatagaaaaaccagataaaaggaacaactgaaattatctgacccatcccctcatcgcctgtgtagaagggaaatgcttactttatctaaccagtggataacagacagcctctttcattttggagctaccaaaaagaaaaataaattgtggtttggttcagttcccttttgaccagtatgttcttgaaatttcgaaaacattttactctttttccttttagtgtttcagtgtggataatttcatttgatctattttcaagttcattttttaggccaaaatttgtcaaatattggcaatttcatatgattcaacttaatatattaacctaatgtgccaaattcaaatttgtttctatactactaaataatatcccccgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttatttaagctttatatatttactttttacctgttaattgttgtaatcacccactaaagagtaaattctggctgggcacagtagcttacgcctataatcccagcactttggaaggcccaggtgaatggatcacttgaggccaggagtttgagaccagcctggccaacatggtgaaaccccatctctactacaaataaaaaaattagctgggcatggtgatgcacacctgtgatcccagctacgcaggagactgagacacaataaacgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtatcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatgtaggaggatgtgtatgaatgagcatgtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcctttcttacaatcccggagccagcctcatggccccctctcaaaggcatgagcatcagccagtggacacctcttcttcagagatctgagtccctgcgacactaggtacttcctctgagttccaaggccaccagcaacctccttctcagaagccatcctcccagttatgtgtggcccttcatccaagttaccaagttctaacaacccaaccattttacctttgtttctacaaccctagggttgatcactgcttcgctttctacacttactatctctgtgttacatcagttccccttttgccttcttagacctccaatacctgtataattccttgtgttaaattccctctggtatactgttcattttctatttttttttttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgatcctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaagagacttgattaactcacagttcagcatggctggggagccctcaggaaacttacaatcatgacagaaggagatgcaaatacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttcccaaaagtcccccaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagagattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactatcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagatcttgtcctctgcacacctgcaggaccaacaccatgtgaaagctgccaaggcttggggctcgcacccgctgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagacactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagactgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaaaccccttataaaaccatcagatctcgtgagaatcattcactatcatgagaacagcatgaaggtaactggccccatgattcacctacctcccactgggtccctcccatgacatgtggggattatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttgtaaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaaagaaatgaaaaagcaggaacacatgatagggtagtctgagctctgtacaaataggaacagtaacatagacaaggagtaattagagtaggctgaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaacattattgaatttttatctaaatgtgatggaggatggacaggaagagaattactgattactctcagtcaggattcatcctagcagcaattatttgtaatttaactgaaataagtccatttgactgaagagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaattgttatacacccttcctcacagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattattttattttattttattttattttattttattttattttattttattttattttttgagatggagtcttgctctatcacccaggctggagtgcagtggcacaatctcaactcactgcaacctctgcctcccgtgtttaagcaattctcctgcctcagcctcctgagtagctgggactacagatgcatgccaccacactcagctaattttttgtatttctaatagagatgaggtttcgtcatgttggccaggctggtcttgaactcctggcctcaagtgatcctcctgcctcagcctcccaaagtgctaggattacaggcattagccaccgtgcccagcaattcttttggaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagactgccatgtaggaaacaggatgtctctaaagtgaaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacaaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtacaacatctgctactcctaccaaatgctaagccactatgaggatataatgctttatttttatttatttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgtttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacgtgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcgcagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaaatttttttcaaggaatagaaccactgcacatgctcctcctgatcccccaaagtgtaagattttcatgcaaatagctatctcccaggacttacattagtaaggtatctggatataaaaatcagtgttccctaaatcagctgtgtttccattatatcaaaaataaacttttagaaattaccatttgaattaacaaagatacacacacacacacacacacacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatcatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagaaatagacaaaagtgcccactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttcaggccatgatgggaagggggagctgaacatgcctcatcataccctcctcccttttggaattactggtagaacagactctaagtctgataaaaaaaaaaaaacatttacaatctattctctctgaagtctgctgcctggatacctggaggcttcatctgaatgacaaaaccttcgtctccacaaccccttatcacaagccagatattcctttctattgataataaggaattgccaatcagaaaatctttgaatctgcctatgacttggaagccacctcacccctgcctgctgcttccagttgtcctgcctttccaaactgaaccaatgtaccttttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcacatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcagtaccttttaaagatgttgttgctacattgtcttctcacttgcattatttccaacaagaaatctgatgttttctttgtgcctctgtgtgtagcatgtctttttatctccgatcacttttgagattttctctcactaactttcagtaatttgattattaaatctttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagatagattaacaagagaaaagcagataatcagggaaaaatgagtaactctcaaagaggtggcctagaattttggcttatgtagcatcttcaactaaaagaaagaaagaagggtgttgggaaagcaagctatgggaaagtgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactccgagagggttcttggatctcatgcaaggaagaagttggagtgagtccatagagtaaagtgaaagcaagtttatttaagaaagtaaagaaataaagaatgactactccataggcagaccagccccaagggttactggttggctatttttgtggttatttcttgattatatgctaaacaagggttggattattattcctttccaggaaagggggggtgcaattccaggaactgacagttcctcctctttttagaccatatagtgtaatttcctgatgttgccatagcacttgtaaactgtcatggtgctggtgggagtgtcttttaacatgctaatggttataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcatttttttttaaccctctgtttcattttggattgtttctattgctctgtctttgcattcattaatcttgttttctgtggtctaatgtgctctcaatcccatccagcatactggtattcatctctagaagttggcttttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacatgcacctgtgaaattaaaaaaaaaaagaagaagaaactttttatctgaggaatgtgagcccctttaaattatcaggctcggagaggcattggaatgaaactgcagtcacatcactcccccttgagtgattatcttgtaaagccacttgctatacgggctccagactaactgatgccaagcagccataaaataccatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtaggtgaggcaattgcagggctcatcttttttcttccctatctctcaggggtgactgtcttttgttgcctgatgtccacagtttcaaaaaacattgtttcatgtattttgttcttttgtttaattttgtttaattttgtttcaggtgagaggataaatccagtctctgctactccatcttggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatacactaagtgagggtctttcagaatagcgcttcagtgtctgcacctgactcacactattaggcagttaaaagctggggaatgagctcatgtgaagagtttttccatttcagatgatagctatttttaggaacacaagctacataaatgttttaacccttttcccatccttttcctcttgctgctgtgatacaggaagaaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacatattcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaactcctgggctcaagcaatccacacaccttggcctcccaaagtgttgggattacaggcatgagccactgcacccagcctatctcatcttttaaaaaaaacatatcaaataattgttcataaatcattttctgtagtagagagcaatttttcttaaaattggcaaataagattttgcatctacctttgagaaaattgtatttgtaaagtgattttaaaagaatgaagcctatgagtatgatggcattataaaagtatcagtggccaggcgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaagtattaatatatggaaatacaaatgtcatatatagatgtaaattctcctaattgttcttctgagcatcatgatttttttccatgaatttttattttaagttccagggtacatgcgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcatggggtgggcactgttatactccatcagtgagtacgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagtgatgaggataatgatcatagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgctcgtatagcaatcctcaaatctcagtagcatataaaggtaagcatttagttctcacttacaagtttgcagggcaggtgaggcagctctgcctcaagccacaatgtctaggacagctctgtttcgcactgtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacataccctcatgaggctgtggagagagtgtagattcagggagcggtgagaaactggggccagtacaccaacttacagcatgatttgtcatcatttttcattctctgctagtaagattgccaaagtctctctgcactcattgaattcatttagctctctttagctctctttttttagctctcatttagtttccatttagctctctttctctcttaccacaatacctaaaaatctttttatggggttacaactctgtctcaggagccacctcagtttggtggcacagagctccccacttgtactctgaaactcttttcttgaagatattgctatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagaaacttctggattcaaatgattgtttggaggcattagccaggcattgaaccaattataaagagtgaggttttgccatattctaaccgtaagaaacagaaacggtagagggtaaaaatagaatagaatgtcaatacaactttagccttttccctggattctgagagttcataacctgaaaatcagagattcaaactgggagagatgggctaacaggtatgagcatgggaaaagcatgtttcaagaatttgagatgtatttcccagaaaagcaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagaaggcaaaagaaaatattaataaatgaattattacgcacataatgttttgtatgtacatgtgtttacttttaatacaaaagtaacggactaagttaacatagatgttccaataagataatttatgtttcatttttggcttcaagtatcctcagggttataagtatcataagctgagaccagctgaattggtttgtgggttgatgaggccctatgcctgatttgaatttctcttgaatggtctgcagccctggaccaagttgaagaagccatgagagtctcagcttttttccttaccccattatgagataaactcattccttaaatatcttgctcatttgataaaacttggcacctttctcctttctactggtccctaatacttactacctgtactgtaagctcaaattttttgcaatttctgcctttattatgtaacgtattccactggaatatgtgttacaggaaaggggtcccgatccagacccctagagagggttcttggatatccagcaagaaggaattcagggccagtccataaagtgaaaacaagtttactaggaaagtagaggaataaaagaatggctactccatagagagaacagccctgagggctgctggttgcccatttttatggttatttcttgattatatgttaaacaggggtgggggggtggaccacgcctataatcccagctactccagaggctgagacaagatcatttgaaccccggaggcagaggttgcagtaagctgacatcgctccactgcactccagcctggaccacccagggataatccgtcccccgcaccccgcccccccaaaaaaatcactgccagtaaggaacaaacagccaggacgaagtactaagatgtaaagagatgtaaaatagcccgggcgcggtggctcacgcctgtaatcccagctctttgggaggcctaggcgggcagatcacgaggtcagaagatagagacgatcctggctaacacggtgaaaccccgtctccactgaaaatatttttttaaaaaaaattagccaggcgtggtggagggcgcctgtagtcccagctaatcgggaggctgaggcaggagaatggcattaacctgggaggcggagcttcaagtgaacccagatcgcgccacggcactccagcctgggtgacagtacgagactgtgcctccaaaaaaaaaaaaaaaaaaagaaagatgtaaaataatgtgatacattctgcaagagttatgacagagtcagaaaggggcaagcatgtttcttctctaccctgaagcagccaagggagaagaagatatctgttgccaacgctggggtgttacaagtgcacactgccatgcccggctaattttttggattttagtagagacaaggtttcactgtgttgcccaggctggtctcgaactcctgagctcaggcaatccacccgcctaggcctcacaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtgtaagtatgtccatttacagattgggagatggaggaatcacagagcggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgtgcgcctgtagtctgagctacttgggaggctgaggtgggaggatcgcttgagcctgggagattgaggctgcagtctgcagtgagttatgatcacaccactgcactccagcctgggcaacagagaccctgtcttaaaaacaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacgaggaaaattagagttatcaatgattttgggggatgagtggagtgtagttttcataggctcaaagcaaagcagggctgtgtgaaagggtaggcataggatgggactttgcagtggatccagggtcttgtttcctcagaaactacaacgttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggagaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttatttcccccccctttaatctatattttattttatttattttttacttttttgagacggactctcgctctgtccccagggtggagtgcagtggtgcgatctcagctcactgcaacctctgtctcctgggttcaagcgattctcctgcctcattctcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggtcttcccaagtgctgggattacaggcatgagacaccgcgcctggcctaatctatattttaaaaattgaactcttccatgtacccctgaacctaaaataaaagttaaaaacaaacaaacatacaaaacaacaacaacgacaaaaaaaaaaaaaaaaaaaaaaccaggccgggcatcgtggctcacgcttgtaatcccagcactttggaaggccgaggcgcgcagatcacgaggtcaggagttcgagaccagcttgactaacatggtgaaaccccgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaaaaaaaaagagagagaattctgtactttgtaattagaggggtaattcattaattcatgtcaggggcatattattttatttttccaaatgctaggaagcaggtatccattttttgataatataaattttgggataattggcagtcatctggctcacagggaaaacaggaaaaacaagaaacctaaataaacttcatattgatttcccaaaaaaattaccttttattttcaacccttatagaactcaacctgcatctctttgccatccatgttctttttttttagagactgggcctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttggacctatataagaatttcttttggataaaaactcaggaacagaagtgctgagaagccagaaaccagcagttctgttcagagttttatttacatctaattgaactaaggagtgtcaggctcccctccagaatgcttgtcccggacttccaataccaaggtagctggactctgagcccacatccaggcccagtcctcgggtcatccaactttctaagttttgccagactgcctggtgtaaagtggtatctcagcattgctttcgttttcattgttccgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattttttatttatttatttattatttttttgagacgaagtcttgctcttgtccccgaggctggagtgcaatggcacgatcttggctcactgcaaactccgcctcccgggttcaagtgattctcctgcctcagcctcctgagtagctgggattacaggtgcctgccaccatgcccgactactttttgtatttttagtagagacggggtttcaccatgttggccagactggtctcaaactcctgacctcaggggatccgcccccctcggcctcccgaagtgctgggattacaggcgtgagcgaccgcgccaggcctcaacctacatttcaagtcaccatctgtcacaggataccttccactctggctctggatatgggggtcacctcctcacaaagacagacaggctgtatgtgcatacacagaaagattcagaagaaacatgaagacttttaaaatcagtgagatgattttaactttctttaaatcagtgagatgattttaactttcttctttgtagttttctctagccagttttaaaaactgtaagttgtaggccgggcgcggtcactcacacctgtaatcccagcactttgggaggctgaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgaggcaggagaatcccttgaacccagaaggcagagcttgcagtgagctgagattgcgccactgcactccagcctgggcgatagagcgagactccatctcaaaaaaaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgttgttgagacggagtctcactctgtcgcccaggctggagtgcagtggcagatcttggctcactgcaagctccgcctcccgggttcacgccattctcctgcctcagcctcccgagtagctgggactacaggcgcccgccacccatgcctggctacttttttttaattttttttttttttttgtatttttagtagagacgggttttcaccgtgttaaccaggatggtctcgatctcctgacctcgtgatccgcccgcctcggcctcccaaaatgctgggattataggcgtgagccccagcgcccggccaatgtaaatgtatttcttactgtagacttgaggtcaggagagtgggctgtactggacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagccttttcttctttccagggttgttgtggactcaaacgagaggctgttagtgaaaggtttttgtgagttatgaagctcctaggaacccaattatttctgctgccttggccacatagtctagaagaatctctacataattagcatctagagactagataatttacccattattttccatgtgcttgtcttatttcccagcatgacggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgtccaaccattcaggcttttcattattataggaagcatctggccaaggaccaccaccatcttcctgtcctgcccctgaagctgtgagttccccaagtggagacacagcctgttccccaacacctacactcatgaacatgggagggttggtcaaaattgcacagctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaactaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctccctttttttttttttttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgccggctaatttttgtatttttagtagagacggggtttcaccatgttggttaggctggtctcaaactcctgacctcaagtgatccagccgcctcggcctcccaaattgccgggattacaggcatgagccgccgcgcctggccttgctttttctcttttaaaattactgttactcatggggtatctgcaggcctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattagggatgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtccacttgcaaagacgacagatctctctacaaattctgggctgagcaggtgaaggaggctggtcaggcccatgaaggagcctagtcagccgtaaggaaaggttcactgtggggcccccgactttccattcctgatctcctttttacctctgctgcccacttcctttcctctttccctccaagtataccttatactctgctcctgatgacactcagatctccccccgcccccccgcccccatcaaatataaagagcctagtgacttttgtaagaacggtgtattcatttcctagtgttgcattaataagttaccataaacttagtggtttaaaacaacacaaatttgccgggtgtggtggctcacgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactccgtctcaaaaaaaaaaaaaaaaaaacatgaaaccaaacaaaacgaaaaaaaccacacagatttattctcttaccattctggaggtcagaagcccaaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagattccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgagaagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcccagtctgtaaagtgagaatgataaaacatctgccttccttgcaggattgttgtggtgatgtgtaagacaaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatcagagtaataacaactggtggatgtgttctcctaggtagagaacaggaatctcaatttttaatgttgggagggactttatgcatctttttgctttcaaaagcaatttctggctgggcgtggtggctgatgcctgtaatcccagcactttgggaggccgaggtgggtgaataacttgaagtcaggagttcgagaccagcccagccaacacggtgaaaccccgtctctactaaaaatacaaaaaattagctgggtgtggtggcaggcgcctatgatcccagctacttgggaggctgaggcaggagaatcgcttgaacccgagaggcggaggttgcagtgagcagagatctcgccactgcactccagcctgggcaaccgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaattttttctttctttctttctttctttctttctttctttctttctttctttcttctttcttttttttttttttttttttgatacggagtcttgctctgttgcctaggctggagtgcagtggtgcgatctcagctcactgcaagcaccgcctcccgggttcacgccattctcctgcctcagcctcctgagtagctgggactacaggcacccgccaccacgtccggctaattttttgtatatgtagtagagacggggtttcaccgtgttagccaggatggtctcgatctcctgacctcgtgatctacccgcgttggcttcccaaagtgctgggattacaggtgtcagccaccacgcccggtcaatttttgtatttttagcagagaggaggtttcactgtgttggccaggctggtctcgaactcctgacttcatgtgatcggcccaccttggcctcacaaagtgctgagattacaggcatgagccatcacgccccgccctaaaacaccaaatcttattaaatctatattctacaactctgtcacatccatcacttcatctctgcccactcctagcactgacttagctgaggacatcatcaattctgatcaaaggaccctaagtctaagtaacaataccactttcatggtaggctttccccggaaccagctggacataatgagaattttcaagagaatgtgaattgctctttacttgattttctttttttttgagatggagtatcgcttttgtcgcccaggctggagtgcaatggtgcgatgtcagctcactgcaacctccacctcccgggttcaagcgattctcctgtcagcttagcctcctgggtaggtgggattacaggcgcccgccaccaagcccggctaatttttttttttttttttttgtatttttagtagagatggggtttcaccatgttggtcaggctggtctggaactcctgacctcaggtgatccgtccgcctcggcctcccaaagtgccgggatttcaggcacgagccaccgttcccggcgattttcttttctttaagactaatctgaaagtgcggaactctgtgtacctgaaatgattacattttgatattgacatgaaaaaattgggtactactttgccccagtttctcaacccaacaaagacattccaaaagtttcctatggggcctaggaaggttggccttcacaggatagtggcaggagtgttaactttgtcctattaccaaaaggtgtcaaagctgttactaaattgtctgtgtcagtatcggaaaccccgacagcactggagaattcctcatggtccttccagaccatggtcacagtgagaagcagattctgttgccctggccctgtggggaaatccccaagatggctgctgatagttaaggaaacagtgtcctgccatggcctgaccctaggctgggtgagagagagtgggtcagacaggctgcacttcctcagtgagtgtgcatacacctgttcgcactgcctatcgtttcctcacccagtgtgagagcagggggctcagttgggctgagtggagaattcatgggacctttccatggtcaaggcccagagcttctattgtgtagcatccctggaacagagaacaggaggcagtcacaaggccccagcttcaacctttgacagtacaccagaaaagaccaagtagtgaggcctccactgtctcacaccagccaagaaagaccaggtcttagactatccagtgttcctgcctctctttcacggtgctgtatctggggaatgaatactccattgtcataggaggggcagatgcgggcggaagactcagaagggtcaaggtaggacatagacattcccactaagctagagacccctgaactgccatagccatgacatgcacacgttgtcctcaaatcccagggccatgggcaggtcttggatatctttggaattttaagttggttggcatctgtctagttttaaacctgatttaggttcagttcaaccagggagtatgattctttggggagagggccctgacctagaaatctacatgctcagcggtctgctcagccactaatggctctgacacactggaaaggcactcaccctctgggagtttcagactgtatctttgaaaacaaaattcagtggatggggtgcaaaggtattgtcctcaacagctctaagttactacttctaactcacagagcacatatcacaaaggatcccactatccattgtcggtctgagcagggaatgagactttggcagaccatgaatcctgtattaatttctagggggactataacaaaataccacagacttgggggtttaaactgagattgcaccactgcactccagcctgggtgacagagtaagaccctgagtcaaacaaaaaaaaaaaaagtgtatacatgggagcactctgtgatgagtaactcaaaggagtggttagaatttgggatctacctagcagcaggggaaaaggaggaggagtaaaggacatatggaaaaccaaatgacttttgaaaagataaatgggcccttagaatagatggaagattcgagtcttgtgacaatgtctatttgggtgtggtgaccacttctcatctccgaggttagatttgcttctagtgctgaagaagatttatgacaactgagttaaaaatttgagatttgcgaggaggatctgctattaaacaggtaagggattttagctgtttgtttcagctgaaaataattcttaagtcgaaactggcacatttggaggtagcatgtcctgatccccttaaaaagggaactgcacagacaccgtatctctgattctgcccagggtcctgtgccctctgacaccagaaatcaccacttctctcagccttgttttgcggttgttttatcatgttgcaatttggttatgtcttttctaatagtgtttaaaagcaatcaaaggcaggaacttttccttttataaactattgttgagcttatattggacactgaactaagtgtcagtttacaaaaatgaataaacaaaaatcactgccagtagggaacacacagccaagatgggggagtagtaagatgtaaagagatgtaaaataatgtgatagattcggccagagttactaaagagtcagaaaagggcaagcatgtttcttccctgtcctgaagcagccaagggagaggaagatatctgttgccaatgctggggtgttggtttaggcatgtagatgctgtgatgcgcagtggaaccgttcaatgagcagacaggagaaccagctttatgcggggagggagagaattgctcccctcatcccccgtgagtcacaccctggagattataagtttaaacattttgatttcgggagattttgagttttgggcttaaaatgactgaagaaccaccaggtggatctacgtgtctcgagtccagaagtctgaatacagatttacgatttatgagcacacagaaggtggatccaagggagagattaaacagggcacagaagagtttttaaaaataatatttttcgggaaaaaaaccccaacaaaacacgattctttcagcagaaaccagaagattttctcatagactctcctacagagagccctgataaagtaataaacatgctaacagtaagaaccccaaccaatttcatagggcagtttgcggtaactactcccagtatggagcagacagtcctcttgcaaaacccgatttagcaaactttgctagctccatgtggggcctccaaaggacacagctgggcactaaatcctggctgaaaacaaaggccgatttagaggatccgtagaaacggatgcacagaatatccctcagtcttctctatgtagcaggccctccatatacgcgggttccccaagaccgaaaatattaaacaaatgaatttcttttttaaaaaaaagtacaacaaaagatagtaaaaataaaaacagtataacaattacttacatagcatttacactggattaggtgttacgaagtaatttagagactatttaaagtacacgggaggatgtgcatagttatgtgcaaatactacgccactttctatgagagacttgagcaacctggattttggtatcggcgggggccctggaccaatcccctctcagttctaccgagggagaactgttttgtttcttccagcacggctttgaccgacagtgtgttgggattcgctgacgtccatgagaaagcttggcagcatgctgagaccaattttcccagggccagaattctcctgtgtgagctaaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgct
